United States Patent 11,111,481 (ATTENUATED VIRUS MUTATED AT SITES OF EVOLUTIONARILY CONSERVED RNA STRUCTURE) - sequence listing, part 3

SEQ ID NO: 634 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgctactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacctggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcttagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggttatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagagaaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggcgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 635 - DNA, 10179 bp, Dengue virus
atgaacaaccaacgaaaaaagacggctcgaccgtctttcaatatgctgaaacgcgcgagaaaccgcgtgtcaactgtctcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccctggcgttccatttgactacacgagggggagagccgcacatgatagtcagcaagcaggaaagaggaaagtcacttttgtttaagacctcagcaggtgtcaatatgtgcacccttatagcgatggatttgggagagttatgtgaggacacaatgacttacaaatgccctcgaatcactgaggcggaaccggatgacgttgattgttggtgcaatgccacagacacatgggtgacctatggaacatgttcccaaactggcgagcaccgacgagaaaaacgttccgtcgcactggccccacacgtgggacttggtttggaaacaagaactgaaacgtggatgtcctctgaaggcgcttggaaacagatacaaagggtggagacttgggccctgagacacccaggattcacggtgatagccctttttctagcacatgccataggaacatctatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacttcgggagcttcgacatcacaagagacttggaatagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagactcagcatggaaccgttctagtgcagattaaatatgaaggaacagatgcaccatgcaagattcctttttcgacccaagatgaaaaaggagtaacccagaatgggagattgataacagccaaccccatagtcactgacaaggaaaaaccagtcaatattgaggcagaaccgccttttggtgagagttacatcgtgataggagcaggtgaaaaagctttgaaactaagctggttcaagaaaggaagtagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggtatctttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggttcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggctactggatagaaagtgaaaagaacgagacctggaagctggcaagagcctctttcatagaagttaaaacatgcatttggccaaaatcccacactctatggagcaatggagttctggaaagtgaaatgataattccaaagatccatggaggaccaatatctcagcacaactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacagttgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcatcatgattttaaaattattgactgactttcaatcatatcagttgtgggctaccttgctgtccttgacatttatcaaaacaacgttttccctgcactatgcatggaagacaatggctatggtactgtcaattgtatctctcttccccttatgcctgtccacgacctcccagaaaacaacatggcttccggtgctattgggatctcttggatgcaaaccactaaccatgtttctaatagcagaaaacaaaatttggggaaggaaaagttggcccctcaatgaagggatcatggctgttggaatagtcagcatcctattaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactcaggtgcctcacacaacatattagtggaggtccaagatgatggaaccatgaagataaaggatgaagagagagatgacacactaaccattctccttaaagcaactctgctagcagtttcaggggtgtacccattatcaataccagcgaccctttttgtgtggcacttttggcagaaaaagaaacagagatctggagtgttgtgggacacacctagccctccagaagtggaaagagcagttcttgatgatggtatctatagaattatgcagagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggtttcaaggatcctggaacacgggagaagaagtgcaggtgattgctgttgaaccagggaaaaaccccaaaaatgtacaaacagcgccgggcacctttaagacccctgaaggtgaagttggagccattgccctagatttcaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgagatggcagaagcgctcaagggaatgccaataaggtaccaaacaacagcagtgaagagtgaacacacaggaaaagagatagttgacctcatgtgtcacgctactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcaatcttcatgacagccactcccccaggatcaatggaggcctttccacagagtaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtatcaaaaaacaaaaaataacgactgggactacgtcgtcacaacagacatctccgaaatgggagcaaatttccgggccgacagggtgatagacccaagacggtgtctgaaaccggtaatattaaaagatggtccagagcgtgtcattttggcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctctttgagccggagagagaaaagagtgcagcaatagacggggaatatagactgcggggtgaagcaaggaaaacgtttgtggagctcatgagaagaggagacctacctgtctggctgtcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacttggtcatgttgcacaactccgaacaaggaggaagagcctatagacatgcaatggaagaactgccagacaccatagaaacattgatgctccttgctttgatagctgtgttaactggtggagtgacgctgttcttcctatcaggaaagggcctagggaaaacatctatcggcctactctgcgtgatggcttcaagcgtactactatggatggccagtgtggagccccattggatagcggcctccatcatactggagttcttcctaatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccctgtgtgaatccatcacactggccactggacctctgaccacgctttgggagggatctccaggaaaattttggaacaccacgatagcggtttccatggcaaacatttttagaggaagttatctagcaggagcaggtttggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggttcgtggagaggaaccttgtgaaaccagaagggaaagtcatagaccttggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattcttcataccacctgagaaatgtgatacccttttgtgtgatattggtgagtcctctccaaacccaactatagaggaaggaagaacgctacgcgttctaaagatggtggaaccatggctcagaggaaaccaattttgcataaagattctgaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagaaaaaaaactaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggggaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatctttttgcccaacgaattagagaccccaaatctagccgggagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgactgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgatatcaatgaagagattcaagaacgagagtgaacccgaaggggcactctggtga

SEQ ID NO: 636 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgctggtgcaatgccacagacacatgggtgacctatggaacatgttcccaaactggcgagcaccgacgcgacaaacgttccgtcgcactggccccacacgtgggacttggtttggaaacaagagccgaaacgtggatgtcctctgaaggcgcttggaaacagatacaaagagtggagacttgggccctgagacacccaggattcacggtgatagccctttttctagcacatgccataggaacatccattacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaagggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttgcatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggactatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgtagctggaatcttggctcaaggaaaaaaaatgattaggccacaacccatggaacacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgcttcaaaggagaggatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctttaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcttgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggcaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacctgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgcggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgatacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcgagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagtttgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 637 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagatctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctaataacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccattgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagctggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagagaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatagaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgctgcaatgctggacgtagacttacatccagcttcagcctggaccctctatgcagtggccacaacaattatcactcccatgatgaggcacacaatcgaaaacacaacggcaaacatttccctgacagccattgcaaatcaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcggtgttcgttgatgaaaatcaatggaactcggcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagactacatgacatcaatgaagagattcaagaacgagagtgatcccgaaggggcactctggtga

SEQ ID NO: 638 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgtattgaagctaaaatatcaaacaccaccactgattcaagatgtccaacacaaggagaagccacactggtggaagaacaagacgcgaactttgtgtgtcgacgaacgtttgtggatagaggctggggcaatggatgtgggctcttcggaaaaggaagcctaataacgtgtgctaagttcaagtgtgtaacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcaacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatctttgcaggacacttgaaatgtagactaaagatggacaagctgactctaaaagggatgtcatatgttatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgtcgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatctgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttgtgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtatcaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacgacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggagatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaaaggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccactggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaataagaaaccgagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggcagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 639 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcacagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagccatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaaaaaaatgattaggccacaacccatggaatataaatactcatggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaggaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccatagctctagattttaaacccggcacatctggatctcccatcgtgaacagagaaggaaaaatagtaggtctttatggaaatggagtagtgacaacaagtggaacctacgtcagtgccatagcccaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctactcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaagcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacagaaaaccaacatatgaaagagacgtggacctaggcactggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcaattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 640 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggttagtccacaaacaatggtttttagacctaccactgccttggacctcgggagcttcaacatcacaagagacttggaacagacaagatctgctggtgacatttaagacagctcatgcaaagaagcaggaagtagtcgtgctaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggcttatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagcctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatgatactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcttggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgttcaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctaatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccacttcaaagaaattctactcatgaaatgtattgggtctcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtagaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacttaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 641 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagttacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaacgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgctggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatataaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacttacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcactatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcgaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttggctgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 642 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatggtagtcagcaagcaggaaagaggaaaatcactcttgttcaagacctcagcaggtgtcaacatgtgcacccttatagcgatggatttgggagagttatgtgaggacacaatgacttacaaatgccctcgaatcactgaagctgaaccagatgacgttgactgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacctggaacagacaagatttgctggtgacatttaagacagctcatgcaaagaagcaggaagtagtcgtgctaggatcacaagaaggagcaatgcacactgcgttgaccggagcaacagaaatccaaacgtcaggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggattaggggttctgctgacatggctaggattaaactcaaggagcacgtccctttcgatgacgtgcattgcagttggcctagtaacactatacttaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacgtcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcatgggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaggttcttcttctaacaattggattgagtctagtggcatctgtggagttaccaaattccttggaggagctgggggatggacttgcaatgggcattatgattttaaaattattgacagactttcaatcacatcagctgtgggccaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccatcctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcccctaccagagattgaagacgaggtgtttaggaaaagaaacttgacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgcctataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagtattaaatcaggaaatgacatagccaactgcctaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacgaaagagggagaaagaaagaaactacgaccccgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccctggacaacctggttatgttgcacaactccgaacaaggaggaagagcctacagacatgcaatggaagaactgccagacaccatagaaacgttgatgctcctagctttgatagctgtgttaactggtggagtgacactgttcttcttatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgcggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacccctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagttgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggttgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtgagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgttgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 643 - DNA, 10179 bp, Dengue virus; identical to SEQ ID NO: 510

SEQ ID NO: 644 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattattttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctaaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatgggaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattaatacaccagatttttggaactgcatatggagttttgttcagcggtgtttcctggaccatgaaaataggaataggggttctgctgacatggctaggattaaactcaaggagcacgtccctctcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgagaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgccttcgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaatatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggccatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggctgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagctaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagtttttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctactcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatccctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgagaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttttgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacacgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcagcaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacagaagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 645 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcgaaaggattgctctcaggccaaggacccataaaattggtgatggctttcatagcattcctaagatttctagccatacccccaacagcaggaattttggctagatggggctcattcaagaagaatggagcgatcaaagtgcttcggggtttcaagaaagaaatctcaaacatgttgaatataatgaatagaaggaaaagatctgtgaccatgctccttatgctgatgcctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaacaccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgttcgtggacagaggctggggcaatggctgtgggctcttcggaaaaggaagcctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttttagtgcagattaaatacgaaggaacagatgcaccatgcaagatccctttttcgacccaagatgaaaaaggagtaacccagaacgggagattgataacagctaaccccatagtcactgacaaagaaaaaccagtcaacattgaggcagaaccgccttttggtgagagttacatcgtgataggagcaggcgaaaaagctttgaaactaagctggttcaagaaaggaagcagcatagggaaaatgtttgaggcaactgccagaggagcacgaaggatggccatattgggagataccgcatgggactttggttctataggaggagtgttcacgtctgttggaaaactagtacaccagatttttggaactgcatatggagttttgttcagcggtgtttcctggaccatgaagataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtatctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgattttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttctaatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaagaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggctgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagtcgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatactagaaatagggaaacttccacaacacttgacgcaaagggcccagaatgctttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaagggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttatttatgatacttacagtagcagccaatgagatgggactactggaaaccacaaagaaagacttagggattggccatgtggctgttgaaaatcaccaccacgctacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggataatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagctggatgggatacaaggataacagaggatgaccttcagaatgaggccaaaattactgacatcatggagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagcttataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcctgaaggggcactctggtga

SEQ ID NO: 646 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgaccacacgagggggagagccgcacatggtagtcagcaagcaggaaagaggaaaatcactcttgttcaagacctcagcaggtgtcaacatgtgtacccttatagcgatggatctgggagagttatgtgaggacacaatgacttacaaatgccctcgaatcactgaagctgaaccagatgacgttgactgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacctggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggattaggggttctgctgacatggctaggattaaactcaaggagcacgtccctttcgatgacgtgcattgcagttggcctagtaacactatacttaggagtcatggttcaggcggattcaggatgtgtaattaattggaaaggtagagaactcaaatgtggaagtggcatttttgtcaccaatgaagtccacacctggacagagcaatacaaatttcaagctgactccccaaagagactatcagcagccatcgggaaggcatgggaggagggtgtgtgtggaattcgatcagcaactcgtctcgagaacgtcatgtggaagcaaatatcaaatgaactgaatcacatcttacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggccactaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccaccttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagtattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcttatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgcggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccgcaggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaagagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgatacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagtagagagaattcactcagcggagtggaaggagaaggactccacaaacttggatatatactcagagacatatcaaagattccagggggaaacatgtatgcagatgacacagccggatgggacacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtgagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacgtacaagtggccataaaccaagtgagaagactaattgggaatgagaattacctagattacatgacatcaatgaagagattcaagaacgagagtgatcccgaaggggcactctggtga

SEQ ID NO: 647 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgaccacacgagggggagagccgcacatggtagtcagcaagcaggaaagaggaaaatcactcttgttcaagacctcagcaggtgtcaacatgtgtacccttatagcgatggatctgggagagttatgtgaggacacaatgacttacaaatgccctcgaatcactgaagctgaaccagatgacgttgactgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacctggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggattaggggttctgctgacatggctaggattaaactcaaggagcacgtccctttcgatgacgtgcattgcagttggcctagtaacactatacttaggagtcatggttcaggcggattcaggatgtgtaattaattggaaaggtagagaactcaaatgtggaagtggcatttttgtcaccaatgaagtccacacctggacagagcaatacaaatttcaagctgactccccaaagagactatcagcagccatcgggaaggcatgggaggagggtgtgtgtggaattcgatcagcaactcgtctcgagaacgtcatgtggaagcaaatatcaaatgaactgaatcacatcttacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggccactaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccaccttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagtattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcttatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgcggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaagagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgatacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagtagagagaattcactcagcggagtggaaggagaaggactccacaaacttggatatatactcagagacatatcaaagattccagggggaaacatgtatgcagatgacacagccggatgggacacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtgagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacgtacaagtggccataaaccaagtgagaagactaattgggaatgagaattacctagattacatgacatcaatgaagagattcaagaacgagagtgatcccgaaggggcactctggtga

SEQ ID NO: 648 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaaatggtaatggctttcatagcattcctaagatttctagccatacctccaacagcaggaattttggctagatggggctcattcaagaagaatggagcgatcaaagtgctacggggtttcaagaaagaaatctcaaacatgctgaatataatgaatagaaggaaaagatctgtgaccatgctgctcatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgtagattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattatcttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctctaacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagtcactcgtctcgagaatatcatgtggaagcaaatatcaaatgaactgaaccacatcctacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacacaaccttcatcatcgacggcccaaacaccccagaatgccctgatgatcaaagagcatggaacatttgggaagttgaggactatggatttggaattttcacgacaaatatatggttgaaattgcgtgactcctacactcaagcgtgtgaccaccggttaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggagagtgaaatggtaattccaaaaatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagataccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaacgatgtgccgctagctgggccactaatagctggaggcatgctaatagcatgttatgttatatctggaagctcagctgacttatcactagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccagaggagctgtactcatgtatcaagggaagagactggaaccgagttgggccagtgtcaaaaaagacctgatctcatatggaggaggttggaggcttcaaggatcctggaacacgggagaggaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaaggtcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaactcgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttgaaaatcaccaccatgccacaatgctggatgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacccggacatgaggaaccaatcccaatggcgacctatggatggaacctagtaaaactgcactccgggaaagacgtattctttacaccacctgagaaatgtgacacacttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaaccgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatttgtacaagagaggagttcacaaggaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattaccgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaatgagggtgatcccgaaggggcactctggtga

SEQ ID NO: 649 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttagaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcaacagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacagtggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaagctgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgctcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacaccctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttgccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaacgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgacaatataaacacaccagaagggattatcccagctctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttattattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtaaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcaacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacaccacaccctttggacaacagagggtgtttaaagagaaagttgacacacgcacaccaaaagcaaaacggggcacagcacaaatcatggaggtgacagccaagtggttatggggttttctctctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacagatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 650 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttaaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgccaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttaaaatgtagactaaagatggacaagctgactctaaaagggatgtcatatgtaatgtgcacaggctcattcaagctagagaaagaagtggctgagacccagcatggaaccgttctagtacagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaagctggggaaaggctaaaatcataggggcagatgtgcagaataccacattcatcatcgacggcccaaacaccccagaatgccctgatgaccaaagagcatggaacatttgggaagttgaggactatggatttggaattttcacgacaaatatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgttgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccctggaggagctgggggatggacttgcaatgggcattatgattttgaaattattgaccgactttcaaccacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagagaacgtgttccacacaatgtggcatgtcaccaggggagccgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggctagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagatatctccgaaatgggagcaaatttccgggccgacagggtgatagacccaagacggtgtctgaaaccggtaatactaaaagatggtccagagcgtgtcattttagcaggaccgatgccagtgactgtagccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaataaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaacctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatagcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtactgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagtaggtctggccttctcattaatgaaatctctaggaggaggtaggagaggcacgggagcccaaggggaaacactgggagagaaatggaagagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatattattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaatccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgatttacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtctacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagacctcaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgacatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagagaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 651 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaagcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcatagtgggacaattgacatggaatgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcagttgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaagaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatttacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagcctcattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaacccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactgggcctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagctggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaagtatggcgtcgaaaggctgaaaagaatggcaatcagcggagatgactgcgtggtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 652 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgagcattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatttagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcagctgaggtctcctgggaagaagaagcagaacactctggtgcctcacacaacatattagtggaagtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcgtggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcggccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgcggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 653 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagagggcatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgctcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgagcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgttcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcggaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtag

SEQ ID NO: 654 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagatcttggtgaattgtgtgaagatacaatcacgtacaagtgtcccctcctcaggcaaaatgaaccagaagacatagattgttggtgcaactctacgtccacatgggtaacttatgggacatgtgccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagactttgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcctctgcaaacactccatggtagacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccgatcgtaacagaaaaagatagcccagtcaacatagaagcagaacctccattcggagacagctacatcatcataggagtagagccgggacaattgaaactcaactggtttaagaaaggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctttggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatatagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccctgggcatgatggtcctcaaaatagtgagaaatatggaaaagtaccaattggcagtgactatcatggctatcctgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaaccctttcgagaaccagcaagaaaaggagctggccgctaaatgaggctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcataaagggaagaggattgaaccatcatgggcagacgtcaagaaagacctaatatcatatggaggaggctggaagctagaaggagaatggaaggaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccattatggaccttcatccaggagcaggaaagacaaaaagataccttccagccatagttagagaagccataaaacgtggcttgagaacattaatcctggctcccactagagtcgtggcagctgaaatggaggaagctcttagaggacttccgataagataccaaaccccagccatcagagccgagcacaccgggcgggagatcgtggacctaatgtgtcatgccacatttaccatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatattaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttgccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaagtctttgaccctgaacctaatcacagaaatgggtaggctaccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttctgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaactcaggaatctgagagcaacatcctggacatagatctacgtcctgcatcagcatggacgctgtatgccgtggctacaacatttgttacaccaatgttgagacatagcattgaaaattcctcagtgaatgtgtccctaacagccattgctaaccaagccacagtgctaatgggtcttgggaaaggatggccattgtcaaagatccacatcggagttcccctccttgccattggatgctactcacaggtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagatccaataccctatgatccaaaatttgaaaagcagttaggacaagtaatgctcctaatcctctgcgtgactcaagtattaatgatgaggactacatgggctctgtgtgaggctctaaccttagcgaccgggcctatctccacactgtgggaaggaaatccagggaggttttggaacactaccattgcagtgtcaatggctaacatctttagagggagctacttggccggagctggacttctcttttccatcatgaagaacacaacaaacacaagaagaggaactggcaacataggagagacacttggagaaaaatggaaaagccgattgaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgcatccgggaacatagtgtcatcagtgaacatgatttcaaggatgttgattaacagattcacaatgaaacacaagaaagccacctacgagacagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccctgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctttggaaagaactaggaaagaaaaagacacctaggatgtgtaccagagaagaattcacaagaaaggtgagaagcaatgcagccttgggggccatattcactgatgagaacaaatggaaatcggcacgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagaaatggtaacaaaccacatggaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagctcaattaattagacagatggagggagaaggaatcttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgctatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 655 - DNA, 10176 bp, Dengue virus
atgaataaccaacggaaaaaggcgagaaatacgcctttcaatatgctgaaacgcgagagaaaccgcgtgtcaactgtgcagcagctgacgaagagattctcacttggaatgctgcagggacgaggaccattgaaactgttcatggccctggtggcattccttcgtttcctaacaatcccgccaacagcagggatattaaaaagatggggaacaatcaaaaaatcaaaggctatcaatgtcttgagagggttcaggaaagagattggaaggatgctgaacatcttgaacaggagacgtagaactgcaggtgtaattattatgatgattccaacagtgatggcattccatttaaccacacgcaacggagaaccacacatgatcgtcagtagacaagagaaagggaaaagtcttctgtttaaaacagagaacggtgtgaacatgtgtaccctcatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgctccacatgtgggaatgggactggagacacgaactgaaacatggatgtcatcagaaggggcctggaaacatgcccagagaattgaaacttgggtcttgagacatccaggcttcaccataatggcagcaatcctggcatataccataggaacgacatatttccaaagagtcctgattttcatcttactgacagctgtcgctccttcaatgacaatgcgctgtataggaatatcaaatagagactttgtggaaggggtttcaggaggaagctgggttgacatagtcttagaacatggaagctgtgtgacgacgatggcgaaaaataaaccaacattggattttgaactgataaaaacggaagccaaacatcccgccactctaaggaagtattgtatagaggcaaagctgaccaacacaactacagcatctcgctgcccaacacaaggagaacctagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaacgacacaggaaaacacggcaaggaaattaaagtaacaccacagagttccattacagaagcagaactgaccggctatggcactgtcacgatggaatgctctccgagaacgggcctcgactttaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggctacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagagcctccattcggagacagctacatcattataggagtagaaccgggacaactgaagctcaactggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacactgtacttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcattagaagttgaagactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaactacagaccaggttatcatacacaaacggcaggaccctggcatctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagaaatgctcaggacccgagtaggaacgaaacatgcaatattactagttgcagtttctttcgtgacattgatcacagggaacatgtcctttcgagatttggggagagtgatggttatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctagctttggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtagctggagggcttctcactgtgtgttacgtgctcactggaagatcggctgatttggaactggagagagctgctgacgtaagatgggaagaacaggcagaaatatcaggaagtagtccaattctgtcaataacaatatcggaagatggtagtatgtcgataaaaaatgaagaagaagaacaaacactgaccatactcattaggacaggactgctggtgatatcaggactttttcccgtgtcaataccaatcacggcagctgcatggtacctgtgggaagtgaaaaaacaacgagccggagtattgtgggatgtcccttcacccccacctgtgggaaaggccgaactggaagatggagcctatagaatcaagcagaaagggattctaggatactcgcagatcggagtcggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaaccataggcgccgtatctctggacttttctcctggaacctcaggatctccaatagttgacaaaaaaggaaaagttgtgggcctttatggcaacggtgtcgtcacaaggagtggaacatatgtgagtgccatagcccagactgaaaaaaacattgaagacaatccagagattgaagatgacatctttcgaaagaaaagattaaccatcatggacctccacccaggagcgggaaaaacgaagagataccttccagcaatagtcagagaagccataaaacgaggcttgaggacactaatcctggcccccactagagttgtggcggctgaaatggaagaagctctcagaggacttccaataagatatcaaaccccagctatcagagccgagcacactgggcgggagattgtggatctaatgtgtcatgccacatttaccatgaggctgctgtcaccaattagagtaccaaattacaacctgatcatcatggatgaagcccatttcacagacccagcaagcatagcagctagaggatatatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggctgagagggttatagaccccaggcgctgcatgaaaccagtcatactaacagacggtgaagagcgggtgattctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaactacgcagacagaagatggtgctttgatggagtcaaaaacaaccaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcattagacaacttagcagtcctgcatacggctgaagcaggcggaagggcgtacaatcatgctcttagtgaactgccggagaccctggagacattgcttttactgacactcttggccacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaactatggcaaatgagatgggtttcctggaaaaaacaaagaaagatttcggattgggaagcattgcaacccagcaacctgagagcaacatcctggacatagatctacgtcctgcatcagcttggactctatatgctgtggcaacaaccttcatcacaccaatgttgagacacagcattgaaaattcctcagtgaatgtgtctctaacggccattgccaaccaagccacagtgttaatgggtcttgggaaaggatggccattgtcaaaaatggacatcggagttccccttctcgctatcgggtgctattcacaagtcaaccccataactctcacggcagcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgaccgggcccatctccacactgtgggaaggaaatccagggagattttggaatacaactattgcagtgtcaatggctaacatttttagagggagttacttggccggagccggacttctcttttctatcatgaagaacacggctaatacaagaaggggaactggcaacacaggagagacgcttggagaaaaatggaaaaaccgattgaatgcattggggaagagtgaattccaggtctataagaaaagtggaatccaggaggtggatagaaccttagcaaaagaaggcatcgaaagaggagaaacggaccatcacgctgtgtcgcgaggctcggcgaaactgagatggttcgtcgagagaaacctggtcacaccagaagggaaagtagtggacctcggttgcggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgttttttttactccgccagaaaagtgtgacacgttgctgtgtgacataggggagtcgtcaccaaaccccacggttgaggcaggacgaacactcagagttctaaacctagtggaaaattggctgaacaacaacacccagttttgcataaaggttctcaacccatatatgccctcagtcatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagcggaacccgcaacatcggaattgaaagtgagataccaaatttagacataattgggaaaagaatagaaaagataaaacaagagcatgaaacatcatggcactatgaccaagaccacccatacaaaacgtgggcctaccatggcagctacgaaacaaagcagactggatcagcatcatccatggtgaacggagtggttaggctgctaacaaaaccttgggatgtcatccctatggtgacacagatggcaatgactgacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagcggacaagttgtcacgtacggccttaatactttcaccaacatggaagcccaactgatcagacagatggagggagaaggagtcttcaaaagcatccagcacctgacagtcacagaagaaattgcagtaaaaaactggttagcaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgtagaaaccaagatgaactgattggtagggcccgaatttcccagggagccgggtggtctttgcgggaaacagcctgtttggggaagtcttatgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagatatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 656 - DNA, 10176 bp, Dengue virus
atgaataaccaacggaaaaaggcgagaagtacgcctttcaatatgctgaaacgcgagagaaaccgcgtgtcgactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagtaggcgtgattattatgttgattccaacagcgatggcgttccatttaaccacacgtaatggagaaccacacatgatcgttggtagacaagagaaagggaaaagtcttctgttcaaaacagaggatggtgtgaacatgtgtaccctcatggccatagatcttggtgaattgtgtgaagatacaatcacgtacaagtgccccctcctcaggcagaatgaaccagaagacatagattgttggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacctggatcttgagacatccaggctttatcataatggcagcaatcctggcatacaccataggaacgacacatttccaaagggccctgattttcatcttactgacagctgtcgctccttcaatgacaatgcgttgcataggagtatcaaatagagactttgtagaaggggtttcaggaggaagctgggttgacatagtcttagaacatggaagttgtgtgacgacgatggcaaaaaacaaaccaacattggattttgaactgataaaaacagaagccaaacaacctgtcactctaaggaagtactgtataaaagcaaagctgaccaatacaacaacagaatctcgttgcccaacacaaggggaacccagtctaaatgaagagcaggacaaaaggttcgtctgcaaacactccatggtagacaggggatggggaaatggatgtggattatttggaaagggaggcattgtgacctgtgctacgtttacatgcaaaaagaacatggaaggaaaaatcgtgcaaccagaaaatttggaatacaccatcgtgataacacctcactcaggagaagagcacgctgtaggtaatgacacaggaaaacatggtaaggaaatcaaaataacaccacagagttccatcacagaagcagaactgacaggctatggcaccgtcacgatggagtgctctccgagaacgggccttgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactattcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaacccgatcgtaacagaaaaagatagcccagtcaacatagaagcagaacctccattcggagacagctacatcatcataggagtagagccgggacaattgaaactcaactgggttaagaaaggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcctttagtggggtctcatggactatgaaaatcctcataggagtcatcatcacatggataggaatgaattcacgtagcacctcactgtctgtgtcactagtattggtgggagtcataacactgtacttgggagccatggtgcaggctgatagtggttgcgttgtgagctggaaaaacaaagaactgaaatgtggcagcgggattttcatcacagataacgtgcacacatggacagaacaatacaagttccaaccagaatccccttcaaaactagcttcagctatccaaaaagctcatgaagaaggcatttgtggaatccgctcagtaacaagactggagaatctgatgtggaaacaaataacaccagaattgaatcacattctatcagaaaatgaggtgaagttgaccattatgacaggagacattaaaggaatcatgcaggcaggaaaacgatctctgcggccccagcccactgagctgaagtattcatggaaaacatggggaaaggcgaaaatgctctccacagaatctcacaaccagacctttctcattgatggccctgaaacagcagaatgccccaacacaaacagagcttggaactcgctggaagttgaagactatggttttggagttttcaccaccaatatatggctaaaattgagagaaaaacaggatgtgttttgtgactcaaaactcatgtcagcagccataaaagacaacagagccgtccatgccgatatgggttattggatagaaagtgcactcaatgacacatggaagatggagaaggcctctttcattgaagttaaaagctgccactggccaaagtcacacaccctctggagtaatggagtattagaaagtgagatgataattccaaaaagttttgctgggccagtgtcacaacacaactacagaccaggctattacacgcagacagcaggaccttggcatctaggtaagcttgagatggactttgatttctgcgaaggaactacagtggtggtgactgaggactgcggaaatagaggaccctctttaagaacgaccactgcctctggaaaactcataacagaatggtgctgccgatcctgcacattaccaccgctaagatacagaggtgaggatggatgctggtatgggatggaaatcagaccattgaaagagaaagaagagagtttggtcgactccttggtcacagccggacatgggcagattgacaacttttcactaggagtcttgggaatggcactattcctggaagaaatgctcaggacacgagtaggaacgaaacatgcaatactgctagttgcagtttcttttgtgacattgattactgggaacatgtcccttagagacctgggaagagtgatggttatggtgggcgctaccatgacggatgacataggtatgggagtgacttatcttgccctactagcagctttcaaagttagaccaacttttgcagctggactactactgagaaagttgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagctatttttctaacaactcttgcgagaaccagcaagaaaaggagctggccgctaaatgaggctatcatggcagtcgggatggtgagcattttagccagttctctcttaaagaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggactctttccagtgtcaataccaattacggcagcagcatggtacctgtgggaagtgaagaaacaacgggctggagtattgtgggacgtcccttcacccccacccgtggaaaaggccgaactggaagatggagcctatagaatcaagcaaaaagggattcttggatattcccagattggaaccggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaagtccaagtcctggcattggaacctggaaaaaatccaagagctgtccaaacgaaacctggacttttcaaaaccaacaccggaaccataggcgccgtatctctggacttttcccctggaacgtcaggatctccaattgtcgacagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgaccatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaaatatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaactctggacatgaatgggtcacggattttaaagggaagactgtttggtttgttccaagtataaaagcgggaaatgacatagcagcttgtctcagaaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgcttgagaggagaagcaaggaaaacctttgtggacctaatgagaagaggggacttaccagtctggttggcctacagagtggcagctgaaggcatcaactacgcagacagaaggtggtgttttgatggagttaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaagtccttgaccctgaacctaatcacagaaatgggtaggcttccaactttcatgactcagaaggcaagagacgcactggataacctagctgtgctgcatacggctgaggcaggtggaagggcgtacaatcatgctctcagtgaactgccggagaccctggagacactgcttttactgacactcctggctacagtcacgggaggaattttcttattcttaatgagcggaaaaggtgtagggaagatgaccctgggaatgtgctgcataatcacggctagtatcctcctatggtatgcacagatacaaccacactggatagcagcttcaataatattggagttttttctcatggttttgctcattccagaaccagaaaaacagagaacaccccaagataaccaattgacctacgttgtcatagccatcctcacagtggtggccgcaaccatggcaaacgagatgggtttcctggaaaaaaccaagaaagatctcggattgggaagcattgcaacccaagaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttcccctccttgccattggatgctactcacaagtcaaccccataactctcacagcagctcttcttttgctggtagcacattatgccattatagggccaggacttcaagcgaaagcaaccagagaagctcagaaaagagcagcagcaggcatcatgaaaaacccaacagtcgatggaataacagtgattgacctagatccaataccctatgatccaaaatttgaaaaacagttaggacaagtaatgctcctaattctctgcgtgactcaagtattaatgatgaggactacatgggctctgtgtgaggctctaaccttagcgaccgggcccatctccacattgtgggagggtaatccagggaggttttggaacactaccattgcagtgtcaatggctaacatctttagagggagctacttggccggagctggacttctctttttcatcatgaagaacacaacaaatacaagaagaggaactggcaacataggagagacgcttggagagaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtacgtctgcagagtggagttgatgttttcttcactccgccagaaaagtgtgatacattgttgtgtgacataggggagtcgtcaccaaatcccacgatagaagcaggacgaacactcagagtcctcagcttggtggaaaattggttgaacaatgacacccaattttgcataaaggttctcaacccatatatgccctcagttatagaaaaaatggaaacactgcaaaggaaatatggaggagccttagtgaggaatccactctcacgaaactccacacatgagatgtactgggtatccaatgctactgggaacatagtgtcatcagtgaacatgatttcaaggatgctgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacatgggcttaccatggcagctatgaaacaaaacagactggatcagcatcatccatggtgaacggagtggtcagactgctgacaaaaccttgggacgtcgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggggccatattcactgatgagaacaaatggaagtcggcacgcgaggctgttgaagataataggttttgggagctggttgacaaggaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcttggagtttgaagccctaggattcttgaatgaagatcactggttctccagagagaactccctgagtggagtggaaggagaagggctgcacaagctaggctacattttaagagacgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatatttaaattaacgtaccaaaacaaggcggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccttcaagaggatggaacgattggacacaagtgcctttctgttcacaccattttcatgagttaatcatgaaagacggtcgcgtgctcgtagttccatgcagaaaccaagatgaactgattggcagggcccgaatttcccagggagctgggtggtctttgaaggagacggcctgtttggggaagtcctacgcccaaatgtggagcctgatgtacttccacagacgtgacctcaggctggcggcaaatgctatttgctcggcagtcccgtcacattgggttccaacaagtcgaacaacctggtctatacacgccaaacatgaatggatgacgacggaagacatgctgacagtctggaacagggtgtggatccaagaaaacccatggatggaagacaaaactccagtggagtcatgggaggaagtcccatacttgggaaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 657 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaagaaatcaaaagctatcaatgttttgagagggttcaggaaagagattggaaggatgctgaacatcttgaacaggagacgtaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggctttaccataatggcagcaatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacctccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcatcacagataacgtacacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaggagaacttggtcaactccttggtcacagccggacatgggcagattgacaacttttcactaggagtcttgggaatggcactgttcctggaagaaatgcttaggacccgagtaggaacgaaacatgcaatactgctagttgcactatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggtcctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaagggcgtacaatcatgctctcagtgaactgccggagaccctggagacactgcttctactgacactcctggcaacagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggcacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 658 - DNA, 10176 bp, Dengue virus
atgaataaccaacgaaaaaaggcgagaaatacgcctttcaatatgctgaaacgcgagagaaaccgcgtgtcgactgtacaacagctgacaaagagattctcacttggaatgctgcagggacgaggaccattaaaactgttcatggccctggtggcgttccttcgtttcctaacaatcccaccaacagcagggatactgaagagatggggaacaattaaaaaatcaaaagccattaatgttttgagagggttcaggaaagagattggaaggatgctgaacatcttgaacaggagacgcagaactgcaggcatgatcattatgctgattccaacagtgatggcgttccatttaaccacacgtaacggagaaccacacatgatcgtcagtagacaagagaaagggaaaagtcttctgtttaaaacagaggatggtgtgaacatgtgtaccctcatggccatggaccttggtgaattgtgtgaagatacaatcacgtacaagtgtccttttctcaagcagaatgaaccagaagacatagattgttggtgcaactctacgtccacatgggtaacttatgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgatagaaacagaagccaaacaacctgccactctaaggaagtactgtatagaggcaaagctgaccaacacaacaacagattctcgctgcccaacacaaggagaacccagcctaaatgaagagcaggacaaaaggttcgtctgcaaacactccatggtggacagaggatggggaaatggatgtggactatttggaaaaggaggcattgtgacctgtgctatgttcacatgcaaaaagaacatgaaaggaaaagtcgtgcaaccagaaaacttggaatacaccattgtgataacacctcactcaggggaagagcatgcagtcggaaatgacacaggaaaacatggcaaggaaatcaaaataacaccacagagttccatcacagaagcagagttgacaggctatggcactgtcacgatggagtgctctccgagaacgggcctcgacttcaatgagatggtgttgctgcaaatggaaaataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacttactgttcacaggacatctcaagtgcaggctgaggatggacaaactacagctcaaaggaatgtcatactctatgtgcacaggaaagtttaaagttgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacagaaaaagatagcccagtcaacatagaagcagaacctccattcggagacagctacatcatcataggagtagagccgggacaattgaagctcaactggtttaagaaaggaagttctatcggccaaatgattgagacaacaatgaggggagcgaagagaatggccattttaggtgacacagcttgggattttggatccctgggaggagtgtttacatctataggaaaggctctccaccaagttttcggagcaatctatggggctgccttcagtggggtctcatggattatgaaaatcctcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaagtgtggcagtgggattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcagccccagcccactgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagtcacacaccctctggagtaatggagtgttagaaagtgagatgataattccaaagaatttcgctggaccagtgtcacaacacaactacagaccaggctaccatacacaaacagcaggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgatgcgttagccttgggcatgatggttcttaaaatggtgagaaaaatggaaaagtatcaattggcagtgactatcatggctatcttgtgcgtcccaaatgcagtgatattacaaaacgcatggaaagtgagttgcacaatattggcagtggtgtccgtttccccactgttcttaacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaacactgaccatactcatcagaacaggattgctggtgatctcaggactttttcctgtatcaataccaatcacggcagcagcatggtacctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgcggcgctgttctaatgcataaaggaaagaggattgaaccatcatgggcggacgttaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatcgccaatcatcgacaaaaaaggaaaagttgtgggtctttatggtaatggtgttgttacaaggagtggagcatatgtgagtgctatagcccagactgaaaaaagtattgaagacaatccagagatcgaagatgacatttttcgaaagagaaaattgaccatcatggacctccacccaggagcgggaaagacgaagagataccttccggccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggtcacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagccgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaagatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgctgcacacggctgaagcaggaggaagggcgtacaatcatgctctcagtgaactgccggagaccctggagacattgcttttactgacacttctggctacagtcacaggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagagaagctcagaaaagagcagcagcgggcatcatgaaaaacccaactgtcgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacatttttagagggagttacttggccggagctggacttctcttttccatcatgaagaacacaaccaacacgagaaggggaactggcaacataggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaagcactacaaaggaaatatggaggagccttagtgaggaatccactttcacgaaactccacacatgagatgtactggttatccaatgcctccgggaacatagtgtcatcagtgaacatgatttcaaggatgttgatcaacagattcacaatgagacacaagaaagccacttacgagccagatgtagacctcggaagcggaacccgcaacatcggaattgaaagtgagataccaaacctagacataatcgggaaaagaatagaaaaaataaaacaagagcatgaaacatcatggcactatgaccaagaccacccatacaaaacgtgggcttaccatggcagctatgaaacaaaacaaactggatcagcatcatccatgggtaacggagtggtcagactgctgacaaaaccttgggacgtcgtccccatggtaacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtataacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccttgagtggagtggaaggagaagggctgcacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaagcattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccaaggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaaaagaagaggaagaggcaggagtcctgtggtag

SEQ ID NO: 659 - DNA, 10176 bp, Dengue virus
atgaataaccaacgaaaaaaggcgagaaatacgcctttcaatatgctgaaacgcgagagaaaccgcgtgtcgactgtacaacagctgacaaagagattctcacttggaatgctgcagggacgaggaccattaaaactgttcatggccctggtggcgttccttcgtttcctaacaatcccaccaacagcagggatactgaagagatggggaacaattaaaaaatcaaaagccattaatgttttgagagggttcaggaaagagattggaaggatgctgaacatcttgaacaggagacgcagaactgcaggcatgatcattatgctgattccaacagtgatggcgttccatttaaccacacgtaacggagaaccacacatgatcgtcagcagacaagagaaagggaaaagtcttctgtttaaaacaggggatggtgtgaacatgtgtaccctcatggccatggaccctggtgaattgtgtgaagatacaatcacgtacaagtgtcctcttctcaagcagaatgaaccagaagacatagattggtggtgcaactctacgtccacatgggtaacttatgggacgtgtaccactacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccatgatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacagaagccaaacaacctgccactctaaggaagtactgtatagaggcaaagctgaccaacacaacaacagattctcgctgcccaacacaaggagaacccagcctaaatgaagagcaggacaaaaggttcgtctgcaaacactccatggtggacagaggatggggaaatggatgtggattatttggaaaaggaggcattgtgacctttgctatgttcacatgcaaaaagaacatgaaaggaaaagtcgtgcaaccagaaaacttggaatacaccattgtgataacacctcactcaggggaagagcatgcagtcggaaatgacacaggaaaacatggcaaggaaatcaaaataacaccacagagttccatcacagaagcagagttgacaggctatggcactgtcacgatgaagtgctctccgagaacgggcctcgacttcaatgagatggtgttgctgcaaatggaaaataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacttactgttcacaggacatctcaagtgcaggctgaggatggacaaactacagctcaaaggaatgtcatactctatgtgcacaggaaagtttaaagttgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacagaaaaagatagcccagtcaacatagaagcagaacctccattcggagacagctacatcatcataggagtagagccgggacaattgaagctcaactggtttaagaaaggaagttctatcggccaaatgtttgagacaacaatgaggggagcgaagagaatggccattttaggtgacacagcttgggattttggatccctgggaggagtgtttacatctataggaaaggctctccaccaagttttcggagcaatctatggggctgccttcagtggggtctcatggactatgaaaatcctcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaagtgtggcagtgggattttcatcacagacgacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcggccccagcccactgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggtcataaaagacaacagagccgcccatgccgatatgggttattggatagaaagtgcactcaatgacacatggaagatagagaaagcctctttcatcgaagttaaaagctgccactggccaaagtcacacaccctctggagtaatggagtgctagaaagtgagatgataattccaaagaatttcgctggaccagtgtcacaacacaactacagaccaggctaccatacacaaacagcaggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaggtcagaccaacttttgcagctggactactcttgagaaagttgacctccaaggaattgatgatgactaccataggaatcgtactcctctcccagagcaccataccagagaccattcttgaactgactgatgcgttagccttgggcatgatggtccttaaaatggtgagaaaaatggaaaagtatcaattggcagtgactatcatggctatcttgtgcgtcccaaatgcagtgatattacaaaacgcatggaaagtgagttgcacaatattggcagtggtgtccgtttccccactgttcataacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaatactgaccatactcattagaacaggattgctggtgatctcaggactttttcctgtatcaataccaatcacggcagcagcatggtacctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgcggcgctgttctaatgcataaaggaaagaggattgaaccatcatgggcggacgttaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagtattgaagacaatccagagatcgaagatgacatttttcgaaagagaaaattgaccatcatggacctccacccaggagcgggaaagacgaagagataccttccggccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggtcacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaaaaaattaaaacccagatggttggatgccaagatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgctgcacacggctgaagcaggtggaagggcgtacaatcatgctctcagtgaactgccggagaccctggagacattgctcttactgacacttctggctacagtcacgggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaggcaaccagagaagctcagaaaagagcagcagcgggcatcatgaaaaacccaactgtcgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacatttttagagggagttacttggccggagctggacttctcttttccatcatgaagaacacaaccaacacgagaaggggaactggcaacataggagagacgcttggagagaaatggaaaatccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaaacactacaaaggaaatatggaggagccttagtggggaatccactctcacgaaactccacacatgagatgtactgggtatccaatgcctccgggaacatagtgtcatcagtgaacatgatttcaaggatgttgatcaacagattcacaatgagacacaagaaagccacttacgagccagatgtagacctcggaagcggaacccgcaacatcggaattgaaagtgagataccaaacctagacataatcgggaaaagaatagaaaaaataaaacaagagcatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtataacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccttgagtggagtggaaggagaagggctgtacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaagcattcagcacctgacagtcacagaagaaatcgccgtgcaaaactggttagcaagagtacggcgcgaaaggttatcaagaatggctatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccaaggagctgggtggtctttgcgagagacggcctgtttggggaagtcctacgcccaaatgtggagcttgatgtacttccacagacgtgacctcagactggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 660 - DNA, 10176 bp, Dengue virus
atgaataaccaacgaaaaaaggcgagaaatacgcctttcaatatgctgaaacgcgagagaaaccgcgtgtcgactgtacaacagctgacaaagagattctcacttggaatgctgcagggacgaggaccattaaaactgttcacggccctggtggcgttccttcgtttcctaacaatcccaccaacagcagggatactgaagagatggggaacaattaaaaaatcaaaagccattaatgttttgagagggttcaggaaagagattggaaggatgctgaacatcttgaacaggagacgcagaactgcaggcatgatcattatgctgattccaacagtgatggcgttccatttaaccacacgtaacggagaaccacacatgatcgtcagtagacaagagaaagggaaaagtcttctgtttaaaacaggggatggtgtgaacatgtgtaccctcatggccatggaccttggtgaattgtgtgaagatacaatcacgtacaagtgtcctcttctcaggcagaatgaaccagaagacatagattgttggtgcaactctacgtccacatgggtaacttatgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggatcttgaactgataaaaacagaagccaaacaatctgccactctaaggaagtactgtatagaggcaaagttgaccaacacaacaacagaatctcgctgcccaacacaaggagaacccagcctaaatgaagagcaggacaaaaggttcgtctgcaaacactccatggtggacagaggatggggaaatggatgtggattatttggaaaaggaggcattgtgacctgtgctatgttcacatgcaaaaagaacatgaaaggaaaagtcgtgcaaccagaaaacttggaatacaccattgtgataacacctcactcaggggaagagcatgcagtcggaaatgacacaggaaaacatggcaaggaaatcaaaataacaccacagagttccatcacagaagcagagttgacaggctatggcactgtcacgatggagtgctctccgagaacgggcctcgacttcaatgaaatggtgttgctgcaaatggaaaataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacttactgttcacaggacatctcaagtgcaggctgaggatggacaaactacagctcaaaggaatgtcatactctatgtgcacaggaaagtttaaagttgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacagaaaaagatagcccagtcaacatagaagcagaacctccattcggagacagctacatcatcataggagtagagccgggacaattgaagctcaactggtttaagaaaggaagttctatcggccaaatgtttgagacaacaatgaggggagcgaagagaatggccattttaggtgacacagcttgggattttggatccctgggaggagtgtttacatctataggaaaggctctccaccaagttttcggagcaatctatggggctgccttcagtggggtctcatggactatgaaaatcctcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaagtgtggcagtgggattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcggccccagcccactgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggccataaaagacaacagagccgtccatgccgatatgggttattggatagaaagtgcactcaatgacacatggaagatagagaaagcctccttcatcgaagttaaaagctgccactggccaaagtcacacaccctctggagtaatgaagtgctagaaagtgagatgataattccaaagaatttcgctggaccagtgtcacaacacaactacagaccaggctaccatacacaaacagcaggaccatggcatctaggtaagcttgagatggactttgatttctgcgaaggaaccacagtggtggtgactgaggactgtggaaatagaggaccctctttaagaacaactactgcctctggaaaactcataacagaatgttgctgccgatcctgcacattaccaccgctaagatacagaggtgaggacggatgctggtacgggatggaaatcagaccattgaaagagaaagaagagaacttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccatagggatcgtactcctctcccagagcaccataccagagaccattcttgaactgactgatgcgttagccttgggcatgatggtccttaaaatggtgagaaaaatggaaaagtatcaattggcagtgactatcatggctatcttgtgcgtcccaaatgcagtgatattacaaaacgcatggaaagtgagttgcacaatattggcagtggtgtccgtttccccactgttcttaacatcctcacagcagaaagcggattggataccattagcattgacgatcaagggtctcaatccaacagctatttttctaacaaccctttcaaaaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaatactgaccatactcattagaacaggattgctggtgatctcaggactttttcctgtatcaataccaatcacggcagcagcatggtacctgtgggaagtgaagaaacaacgggctggagtattgtgggatgtcccttcacccccaccggtgggaaaggctgaactggaagatggagcctatagaatcaagcaaaaagggattcttggatattcccagatcggagccggagtttacaaagaaggaacattccatacaatgtggcatgtcacacgcggcgctgttctaatgcataaaggaaagaggattgaaccatcatgggcggacgttaagaaagacctaatatcatatgcaggaggctggaagctagaaggagaatggaaggaaggagaagaagtccaggtcttggcactggagcctggaaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagtattgaagacaatccagagatcgaagatgacatttttcgaaaaagaaaattgaccatcatggacctccacccaggagcgggaaagacgaagagataccttccggccatagtcagagaggctataaaacggggcctgaggacattgatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggtcacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctggataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggctggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgctgcacacggctgaagcaggtggaagggcgtacaatcatgctctcagtgaactgccggagaccctggagacattgcttttactgacacttctggctacagtcacgggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccaacaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagagaagctcagaaaagagcagcagcgggcatcatgaaaaacccaactgtcgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacatttttagagggagttacttggccggagctggacttctcttttccatcatgaagaacacaaccaacacgagaaggggaactggcaacataggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaagaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaagcactacaaaggaaatatggaggagccttagtgaggaatccactttcacgaaactccacacatgagatgtactgggtatccaatgcctccgggaacatagtgtcatcagtgaacatgatttcaaggatgttgatcaacagattcacaatgagacacaagaaagccacttacgagccagatgtagacctcggaagcggaacccgcaacatcggaattgaaagtgagataccaaacctagacataatcgggaaaagaatagaaaaaataaaacaagagcatgaaacattatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagcggaagtcggcacgtgaggctgttgaagatagtaggttttgggagctggttgacaaggaaaggaatctccatcttgaaggaaagtgtgaaacatgtgtgtataacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccttgagtggagtggaaggagaagggctgcacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagttttcaaaagcattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccctcaagaggatggaacgattggacacaagtgcccttctgttcacaccatttccatgagttaatcatgaaagacggccgcgtacttgtagttccatgcagaaaccaaaatgaactgattggtagagcccgaatttcccaaggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaacttcagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 661 - DNA, 10176 bp, Dengue virus
atgaataaccaacggaaaaaggcgagaaatacgcctttcaatatgctgaaacgcgagagaaaccgcgtgtcaactgtgcagcagctgacgaagagattctcacttggaatgctgcagggacgaggaccattgaaactgttcatggccctggtggcattccttcgtttcctaacaatcccgccaacagcagggatattaaaaagatggggaacaatcaaaaaatcaaaggctatcaatgtcttgagagggttcaggaaagagattggaaggatgctgaacatcttgaacaggagacgtagaactgcaggtgtaattattatgatgattccaacagtgatggcattccatttaaccacacgcaacggagaaccacacatgatcgtcagtagacaagagaaagggaaaagtcttctgtttaaaacagagaacggtgtgaacatgtgtaccctcatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgctccacatgtgggaatgggactggagacacgaactgaaacatggatgtcatcagaaggggcctggaaacatgcccagagaattgaaacttgggtcttgagacatccaggcttcaccataatggcagcaatcctggcatataccataggaacgacatattttcaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgataaaaacggaagccaaacatcccgccactctaaggaagtattgtatagaggcaaagctgaccaacacaacaacagcatctcgctgcccaacacaaggagaacctagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcattcaggggaagagaatgcagtcggaaacgacacaggaaaacacggcaaggaaattaaagtaacaccacagagttccattacagaagcagaactgaccggctatggcactgtcacgatggaatgctctccgagaacgggcctcgactttaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggctacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagctacatcattataggagtagaaccgggacaactgaagctcaactggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtcttagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcattagaagttgaggactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaactacagaccaggttatcatacacaaacggcaggaccctggcatctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagaaatgctcaggacccgagtaggaacgaaacatgcaatattactagttgcagtttctttcgtgacattgatcacagggaacatgtcctttcgagatttggggagagtgatggttatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctagctttggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtagctggagggcttctcactgtgtgttacgtgctcactggaagatcggctgatttggaactggagagagctgctgacgtaagatgggaagaacaggcagaaatatcaggaagtagtccaattctgtcaataacaatatcggaagatggtagcatgtcgataaaaaatgaagaagaagaacaaacactgaccatactcattaggacaggactgctggtgatatcaggactttttcccgtgtcaataccaatcacggcagctgcatggtacctgtgggaagtgaaaaaacaacgagccggagtattgtgggatgtcccttcacccccacctgtgggaaaggccgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacaccggaaccataggcgccgtatctctggacttttctcctggaacctcaggatctccaatcgttgacaaaaaaggaaaagttgtgggcctttatggcaacggtgtcgtcacaaggagtggaacatatgtgagtgccatagcccagactgaaaaaaacattgaagacaatccagagattgaagatgacatctttcgaaagaaaagattgaccatcatggacctccacccaggagcgggaaaaacgaagagataccttccagcaatagtcagagaagccataaaacgaggcttgaggacactaatcctggcccccactagagttgtggcggctgaaatggaagaagctctcagaggacttccaataagatatcaaaccccagctatcagagccgagcacactgggcgggagattgtggatctaatgtgtcacgccacatttaccatgaggctgctgtcaccaattagagtaccaaattacaacctgatcatcatggatgaagcccatttcacagacccagcaagcatagcagctagaggatatatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggctgagagggttatagaccccaggcgctgcatgaaaccagtcatactaacagacggtgaagagcgggttatcctggcaggacccatgccagtgacccactctattgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaactacgcagacagaagatggtgctttgatggagtcaaaaacaaccaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcattagacaacttagcagtcctgcatacggctgaagcaggcggaagggcgtacaatcatgctcttagtgaactgccggagaccctggagacattgcttttactgacgctcttggccacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaactatggcaaatgagatgggtttcctggaaaaaacaaagaaagatttcggattgggaagcattgcaacccagcaacctgagagcaacatcctggacatagatctacgtcctgcatcagcttggactctatatgctgtggcaacaactttcattacaccaatgttgagacacagcattgaaaattcctcagtgaatgtgtctctgacggccattgccaaccaagccacagtgttaatgggtcttgggaaaggatggccattgtcaaaaatggacatcggagttccccttctcgctatcgggtgctattcacaagtcaaccccataactctcacggcagcccttctcttattggtagcacattatgccatcatagggccaggactccaagcgaaagcaactagagaagctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgaccgggcccatctccacactgtgggaaggaaatccagggagattttggaatacaactattgcagtgtcaatggctaacatttttagagggagttacttggccggagccggacttctcttttctatcatgaagaacacggctaatacaagaaggggaactggcaacacaggagagacgcttggagaaaaatggaaaaaccgattgaatgcattggggaagagtgaattccagatctataagaaaagtggaatccaggaggtggatagaaccttagcaaaagaaggcatcgaaagaggagaaacggaccatcacgctgtgtcgcgaggctcggcgaaactgagatgcttcgtcgagagaaacctggtcacaccagaagggaaagtagtggacctcggttgcggcagggggggctggtcatactattgtgggggattgaagaatgtaaaagaagtcaaaggcctaacaaaaggaggaccaggacacgaagaacccattcccatgtcaacatatggttggaatctggtgcgtcttcaaagtggagttgatgttttttttactccgccagaaaagtgtgacacgttgctgtgtgacataggggagtcgtcaccaaaccccacggttgaggcaggacgaacactcagagttctaaacctagtggaaaattggctgaaaaacaacacccagttttgcataaaggttctcaacccatatatgccctcagtcatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagcggaacccgcaacatcggaattgaaagtgagataccaaatttagacataattgggaaaagaatagaaaagataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggatgtcatccctatggtgacacagatggcaatgactgacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtattggacattatatcgagaagagaccaaagaggtagcggacaagttgtcacgtacggccttaatactttcaccaacatggaagcccaactgatcagacagatggagggagaaggagtcttcaaaagcatccagcacctgacagtcacagaagaaattgcagtaaaaaactggttagcaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgtagaaaccaagatgaactgattggtagggcccgaatttcccagggagccgggtggtctttgcgggaaacagcctgtttggggaagtcttatgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagatatgctgacagtctggaacagggtgtggattcaagaaaacccgtggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 662 - DNA, 10176 bp, Dengue virus
atgaataaccaacggaaaaaggcgagaaatacgcctttcaatatgctgaaacgcgagagaaaccgcgtgtcaactgtgcagcagctgacgaagagattctcacttggaatgctgcagggacgaggaccattgaaactgttcatggccctggtggcattccttcgtttcctaacaatcccgccaacagcagggatattaaaaagatggggaacaatcaaaaaatcaaaggctatcaatgtcttgagagggttcaggaaagagattggaaggatgctgaacatcttgaacaggagacgtagaactgcaggtgtaattattatgatgattccaacagtgatggcattccatttaaccacacgcaacggagaaccacacatgatcgtcagtagacaagagaaagggaaaagtcttctgtttaaaacagagaacggtgtgaacatgtgtaccctcatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgctccacatgtgggaatgggactggagacacgaactgaaacatggatgtcatcagaaggggcctggaaacatgcccagagaattgaaacttgggtcttgagacatccaggcttcaccataatggcagcaatcctggcatataccataggaacgacatattttcaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgataaaaacggaagccaaacatcccgccactctaaggaagtattgtatagaggcaaagctgaccaacacaacaacagcatctcgctgcccaacacaaggagaacctagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcattcaggggaagagaatgcagtcggaaacgacacaggaaaacacggcaaggaaattaaagtaacaccacagagttccattacagaagcagaactgaccggctatggcactgtcacgatggaatgctctccgagaacgggcctcgactttaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggctacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagctacatcattataggagtagaaccgggacaactgaagctcaactggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtcttagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcattagaagttgaggactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaactacagaccaggttatcatacacaaacggcaggaccctggcatctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagaaatgctcaggacccgagtaggaacgaaacatgcaatattactagttgcagtttctttcgtgacattgatcacagggaacatgtcctttcgagatttggggagagtgatggttatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctagctttggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtagctggagggcttctcactgtgtgttacgtgctcactggaagatcggctgatttggaactggagagagctgctgacgtaagatgggaagaacaggcagaaatatcaggaagtagtccaattctgtcaataacaatatcggaagatggtagcatgtcgataaaaaatgaagaagaagaacaaacactgaccatactcattaggacaggactgctggtgatatcaggactttttcccgtgtcaataccaatcacggcagctgcatggtacctgtgggaagtgaaaaaacaacgagccggagtattgtgggatgtcccttcacccccacctgtgggaaaggccgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacaccggaaccataggcgccgtatctctggacttttctcctggaacctcaggatctccaatcgttgacaaaaaaggaaaagttgtgggcctttatggcaacggtgtcgtcacaaggagtggaacatatgtgagtgccatagcccagactgaaaaaaacattgaagacaatccagagattgaagatgacatctttcgaaagaaaagattgaccatcatggacctccacccaggagcgggaaaaacgaagagataccttccagcaatagtcagagaagccataaaacgaggcttgaggacactaatcctggcccccactagagttgtggcggctgaaatggaagaagctctcagaggacttccaataagatatcaaaccccagctatcagagccgagcacactgggcgggagattgtggatctaatgtgtcacgccacatttaccatgaggctgctgtcaccaattagagtaccaaattacaacctgatcatcatggatgaagcccatttcacagacccagcaagcatagcagctagaggatatatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggctgagagggttatagaccccaggcgctgcatgaaaccagtcatactaacagacggtgaagagcgggttatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaactacgcagacagaagatggtgctttgatggagtcaaaaacaaccaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcattagacaacttagcagtcctgcatacggctgaagcaggcggaagggcgtacaatcatgctcttagtgaactgccggagaccctggagacattgcttttactgacgctcttggccacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaactatggcaaatgagatgggtttcctggaaaaaacaaagaaagatttcggattgggaagcattgcaacccagcaacctgagagcaacatcctggacatagatctacgtcctgcatcagcttggactctatatgctgtggcaacaactttcattacaccaatgttgagacacagcattgaaaattcctcagtgaatgtgtctctgacggccattgccaaccaagccacagtgttaatgggtcttgggaaaggatggccattgtcaaaaatggacatcggagttccccttctcgctatcgggtgctattcacaagtcaaccccataactctcacggcagcccttctcttattggtagcacattatgccatcatagggccaggactccaagcgaaagcaactagagaagctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgaccgggcccatctccacactgtgggaaggaaatccagggagattttggaatacaactattgcagtgtcaatggctaacatttttagagggagttacttggccggagccggacttctcttttctatcatgaagaacacggctaatacaagaaggggaactggcaacacaggagagacgcttggagaaaaatggaaaaaccgattgaatgcattggggaagagtgaattccagatctataagaaaagtggaatccaggaggtggatagaaccttagcaaaagaaggcatcgaaagaggagaaacggaccatcacgctgtgtcgcgaggctcggcgaaactgagatggttcgtcgagagaaacctggtcacaccagaagggaaagtagtggacctcggttgcggcagggggggctggtcatactattgtgggggattgaagaatgtaaaagaagtcaaaggcctaacaaaaggaggaccaggacacgaagaacccattcccatgtcaacatatggttggaatctggtgcgtcttcaaagtggagttgatgttttttttactccgccagaaaagtgtgacacgttgctgtgtgacataggggagtcgtcaccaaaccccacggttgaggcaggacgaacactcagagttctaaacctagtggaaaattggctgaaaaacaacacccagttttgcataaaggttctcaacccatatatgccctcagtcatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagcggaacccgcaacatcggaattgaaagtgagataccaaatttagacataattgggaaaagaatagaaaagataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggatgtcatccctatggtgacacagatggcaatgactgacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagcggacaagttgtcacgtacggccttaatactttcaccaacatggaagcccaactgatcagacagatggagggagaaggagtcttcaaaagcatccagcacctgacagtcacagaagaaattgcagtaaaaaactggttagcaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgtagaaaccaagatgaactgattggtagggcccgaatttcccagggagccgggtggtctttgcgggaaacagcctgtttggggaagtcttatgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagatatgctgacagtctggaacagggtgtggattcaagaaaacccgtggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 663 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaagaaatcaaaagctatcaatgttttgagagggttcaggaaagagattggaaggatgctgaacatcttgaacaggagacgtaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggctttaccataatggcagcaatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacctccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcatcacagataacgtacacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaggagaacttggtcaactccttggtcacagccggacatgggcagattgacaacttttcactaggagtcttgggaatggcactgttcctggaagaaatgcttaggacccgagtaggaacgaaacatgcaatactgctagttgcactatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggtcctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaagggcgtacaatcatgctctcagtgaactgccggagaccctggagacactgcttctactgacactcctggcaacagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggcacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 664 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaagaaatcaaaagctatcaatgttttgagagggttcaggaaagagattggaaggatgctgaacatcttgaacaggagacgtaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggctttaccataatggcagcaatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacctccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcatcacagataacgtacacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaggagaacttggtcaactccttggtcacagccggacatgggcagattgacaacttttcactaggagtcttgggaatggcactgttcctggaagaaatgcttaggacccgagtaggaacgaaacatgcaatactgctagttgcactatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggtcctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaagggcgtacaatcatgctctcagtgaactgccggagaccctggagacactgcttctactgacactcctggcaacagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcattgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggcacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 665 - DNA, 10176 bp, Dengue virus
atgaataaccaacggaaaaaggcgagaaatacgcctttcaatatgctgaaacgcgagagaaaccgcgtgtcaactgtgcaacagctgacaaagagattctcacttggaatgctgcagggacgaggaccgttgaaactgttcatggccctggtggcattccttcgtttcctaacaatcccaccaacagcagggattctaaaaagatggggaacgatcaaaaagtcaaaggccatcaatgtcttgagagggttcaggaaagagattggaaggatgctgaacatcttgaataggagacgcagaactgcaggcatgatcatcatgttgattccaacagcaatggcgttccatttaaccacacgcaacggagaaccacacatgatcgtcagcagacaagagaaagggaaaagtctcttgttcaaaacagaggatggtgtgaacatgtgtaccctcatggccatggaccttggtgaactgtgtgaagacacaatcacttataactgtcctcttctcaggcagaatgaaccagaagatatagattgttggtgcaactccacgtccacatgggtaacttatgggacatgcactgccacaggagaacacagaagggaaaaaagatcagtggcactcgtcccacatgtgggaatgggattggagacacgaactgaaacatggatgtcatcagaaggggcctggaaacacgcccagagaattgaaacctggatcttgagacatccaggttttaccataatggcagcaatcttggcatacaccataggaacgacatatttccaaagagtcctgatcttcatcttactgacagctgtcgctccttcaatgacaatgcgttgtattggaatatcaaatagagactttgtggaaggggtttcaggaggaagctgggttgacatagtcttagaacatggaagctgtgtgacaacaatggcaaaaaacaaaccaacattggactttgaactgataaaaacagaagctaagcatcctgccactctaaggaagtactgtatagaggcaaagctgaccaacacaacaacagcatctcgatgcccaacacaaggggaacccagcctaaatgaagagcaggacaaaaggttcgtctgcaaacattccatggtagatagaggatggggaaatggatgtggattatttggaaagggaggcatcgtgacctgtgctatgttcacatgcaaaaagaacatggaaggaaaaatcgtgcaaccagaaaacctggaatacaccattgtagtaacacctcactcaggggaagagaatgcagttggaaatgacacaggaaaacatggcaaggaaatcaaagtgacaccacagagttccatcacagaagcagaactgacaggctatggcaccgtcacgatggagtgctctccaagaacgggcctcgacttcaatgagatggtgttgctgcaaatggaaaataaagcttggctggtgcacaggcaatggttcttagacctgccgttaccatggttgcccggagcggacacacaaggatcaaattggatacagaaggagacattggtcaccttcaaaaatccccatgcgaagaaacaggatgttgttgttttaggatcccaagaaggggctatgcatacagcacttacaggggccacggaaatccagatgtcatcaggaaacctattgttcacaggacatctcaagtgcaggctgagaatggacaaactacagctcaaaggaatgtcatattctatgtgtacaggaaagtttaaagttgtaaaggaaatagcagaaacacaacatggaacaatagttatcagagtacagtatgaaggagatggctctccatgtaaaatcccttttgagataatggatttggaaaaaagacatgtcttaggtcgcctgattacagtcaacccaatcgtcacagaaaaagacagtccagtcaacatagaagcagaacctccattcggagacagctacatcattataggagtagaaccgggacaactgaagctcagctggtttaagaaaggaagctcaatcggccaaatgttcgagacaacaatgagaggagcgaagagaatggccattttaggtgacacagcctgggattttggatccctgggaggagtgttcacatctataggaaaggccctccaccaagtttttggagcaatctatggggctgccttcagtggggtctcatggactatgaaaatcctcataggagttgtcatcacatggataggaatgaattcacgtagcacctcactgtctgtgtcattagtattagtgggagtcgtgacattgtatttgggagccatggtgcaggctgatagtggttgtgttgtgagttggaaaaacaaagaactgaaatgtggcagtgggatttttatcacagacaatgtacacacatggacagaacaatacaaattccaaccagaatccccctcaaaactggcttcagctatccagaaagctcatgaagagggcatttgcggaatccgctcagtaacaagactggagaatctaatgtggaaacaaataacaccagaactgaatcacattctatcagaaaatgaggtaaagttgactatcatgacaggagacatcaaaggaattatgcaggcaggaaaacgatccctgcggcctcagcccactgagctgaagtattcatggaaaacatggggcaaagcgaaaatgctctccacagagcctcataaccagacctttctcattgatggccccgaaacagcagaatgtcccaacacaaacagagcttggaactcactagaagttgaagactatggcttcggggtattcaccaccaacatatggctgaagttgaaagaaaggcaggatgtgttttgtgactcaaaactcatgtcagcggccataaaaaacaacagagccgtccatgccgatatgggttattggatagaaagcgcccttaatgacacatggaagatagaaaaagcttctttcatcgaagttaaaagctgccactggccaaaatcacacactctctggagtaatggagtgctagaaagtgagatgataattccaaagaattttgctggaccagtatcacaacataattacagaccaggctattacacacaaacggcaggaccctggcatctaggcaagcttgagatggactttgatttttgtgaaggaaccacagtggtggtgactgaggactgtggaaatagagggccctctctaagaacaactaccgcctctggaaaactcataacagaatggtgttgccgatcctgcacattaccaccactaagatacagaggtgaggatggatgctggtacggaatggaaatcagaccattgaaagagaaagaagagaacttggtcaactctttggtcacagccggacatggacagattgacaacttctcactaggagtcttgggaatggcactgttcctggaagaaatgctcaggacccgagtaggaacaaaacatgcagcattactagttgcagtttctttcatgacattgatcacagggaacatgtctttccgagacctggggagagtgatggttatggtgggggctgctatgacggatgacataggtatgggcgtgacttatctcgccttactagcagctttcaaagttagaccaacttttgcagctggactacttttgagaaagctgacctccaaggaattgatgatgaccaccataggaatcgtactcctctcccagagcaccataccagagactatacttgaactgactgatgcgttggccttgggcatgatgatcctcaagatagtgagaaatatggaaaagtatcaattagcagtgaccatcatggctatcttatgtgttccaaatgcagtgatattacaaaatgcatggaaagtgagctgcacaatactggcagtggtgtccgtttccccactgctcttaacatcttcacagcagaaagcagattggataccattggcattgacgatcaaaggtctcaatccaacagccattttcctaacaaccctttcaagaaccaacaagaaaaggagttggccattaaatgaggctatcatggcagtcgggatggtgagcattttagccagttctctcttgaagaatgacattcccatgacaggaccattagtggctggagggcttctcactgtgtgttacgtgctcactggaagatcggctgacttggaactggagagagccgccgacgtaagatgggaagatcaggcagagatatcaggaagcagtccaattctgtcaataacaatatcggaagatggcagcatgtcgataaaaaatgaagaggaagaacaaacactgaccatactcattagaacaggattgctggtaatatcaggactttttcccatatcaataccaatcacggcagcggcatggtacctgtgggaagtgaagaaacaacgggctggagtattgtgggatgttccttcacccccacctgtgggaaaggccgaactggaagatggagcttatagaatcaagcagaaagggattcttggatactcccagatcggagctggagtttacaaagaaggaacattccatacaatgtggcacgtcacacgtggtgctgttctaatgcataaaggaaagaggattgaaccatcatgggcggatgtcaggaaagacctaatatcgtatggaggaggctggaagttagaaggagaatggaaggaaggagaagaagtccaggtcttggcattagagcctggaaagaatccaagagccgtccaaacaaaacccggtctttttaaaactaacaccggaaccataggcgctgtatctctagacttttctcccggaacgtcaggatctccaatcgtcgacaaaaaaggaaaagtcgtgggtctttatggcaatggtgtcgtcacaaggagtggaacatatgtgagtgccatagcccagactgaaaaaagcattgaagacaatccagagattgaagatgacatctttcgaaaaaaaagattgaccattatggacctccacccaggagcgggaaagacgaaaagataccttccagcaatagtcagagaggccataaaacgaggcttgagaacattaatcctggcccccactagagtcgtggcagctgaaatggaggaagctcttagaggacttccaataagataccaaaccccagccatcagagctgagcacactgggcgagaaatcgtggatttaatgtgtcatgccacattcaccatgaggctgttatcaccagttagagtgccaaattacaacttgatcatcatggatgaagctcatttcacagacccagcaagcatagcagctagaggatacatctcaactcgagtagagatgggtgaagcagctgggattttcatgacagccactcctccgggaagcagggatccctttcctcagagcaatgcaccaatcatggatgaagaaagggaaatccctgaacgttcgtggaattctggacatgagtgggttacagattttaaagggaagactgtttggtttgtcccgagcataaaagcaggaaatgatatagcagcttgcctgagaaaaaatgaaaagaaagtgatacaactcagtaggaagacctttgattctgaatatatcaagactaggaccaatgattgggactttgtggtcacgactgacatttcagaaatgggtgctaattttaaagctgaaagggtcatagaccccaggcgctgcatgaaaccagtcatactaacagacggtgaagagcgggtgatcctggcaggacccatgccagtgacccactctagtgcagcacaaagaagagggagaataggaagaaatccaaaaaatgaaaacgaccagtacatatacatgggagaacctctggaaaatgatgaagactgtgcacactggaaagaagccaagatgcttctagacaatatcaacacgcctgaaggaatcattcccagcatgttcgaaccagagcgtgaaaaggtggatgccattgatggtgaataccgcttaagaggagaagcgaggaaaacctttgtggacctaatgagaagaggagacctgccagtctggctggcctacagagtggcagccgaaggcattaactatgcagacagaaggtggtgttttgatggaatcaagaacaaccaaatcttggaagaaaacgtggaagtggaaatctggacaaaagaaggggaaaggaagaaattgaaacccagatggttggatgctaggatctactctgacccgctggcgcttaaagaattcaaagagtttgcagccggaagaaaatccctgaccctgaatttaatcacagaaatgggtaggcttccaacttttatgactcagaaagcaaggaacgcactggacaacttagcagtcctgcatacggctgaagcaggcggaagggcgtacaatcatgctctcagtgaactgccagagaccctggagacattgcttttgctgacacttttggctacagtcacgggcggaatttttttattcttgatgagtggaaaaggtatagggaaaatgaccctgggaatgtgctgcataatcacggccagtattctcctatggtacgcacaaatacagccacactggatagcagcttcaataatactggagttttttctcatagttttactcattccagagccagaaaagcagagaacaccccaagataaccaattgacttacgttgtcatagccatcctcacagtggtggccgcaaccatggcaaacgagatggggttcctggaaaaaacgaagaaagatttcggattgggaagcattgcaacccagcaacccgagagcaacatcctggacatagatctacgtcctgcatcagcatggaccctgtatgcagtggccacaacatttatcacaccaatgttgagacatagcattgaaaattcctcagtgaatgtgtctctaacagccattgccaaccaagccacagtgctaatgggtcttgggaaaggatggccattgtcaaaaatggacattggagttccccttctcgccatcgggtgctattcacaagtcaaccccataactctcacagcagcccttcttttattggtagcacattatgctatcatagggccaggactccaagcgaaagcaaccagagaagcgcagaaaagagcagcagcaggcatcatgaaaaacccaactgtggatggaataacagtgattgacctagatccaataccctatgatccaaagtttgagaagcagctgggacaagtaatgctcctagtcctctgcgtgactcaagtactgatgatgaggactacatgggctttgtgtgaagctctaaccttagcgaccgggcccatctccacattgtgggaaggaaatccagggagattttggaatacaactattgcagtgtcaatggctaacatctttagagggagttacttggctggagctggacttctcttttctatcatgaagaacacaatcaacacaagaaggggaactggcaacacaggagagacgcttggagagaaatggaaaaaccgattgaatgcattggggaagagtgaattccagatctacaagagaagcggaatccaggaagtggatagaaccttggcaaaagaaggcattaaaagaggagaaacggaccatcatgctgtgtcgcgaggctcagcaaagctgagatggttcgtcgagagaaacctggttacaccagaggggaaagtagtggacctcggttgcggcagagggggctggtcatactattgtgggggtctaaagaatgtaagagaagtcaaaggcctaacaaaaggaggaccaggacacgaagaacccattcccatgtcaacatatgggtggaatctcgtgcgtctccaaagtggagttgatgttttctttactccgccagaaaagtgtgacacattgttgtgtgacataggggagtcgtcaccaaatcccacggttgaagcaggacgaacactcagagtcctaaacttggtagaaaattggctgaacaacaacacccaattttgcataaaggttcttaacccatacatgccctcagttatagaaaaaatggaagcgctgcaaaggaaatacggaggagctttggtgaggaatccactctcaagaaattccacacatgagatgtattgggtatccaatgcttccgggaacatagtgtcatcagtgaacatgatttcaaggatgttgatcaacagatttacaatgagacataaaaaagccacatacgagccagatgttgacctcggaagcggaactcgtaacatcggaattgaaagtgagacaccaaacctagacataattgggaaaagaatagaaaaaataaaacaagagcatgagacatcatggcactatgaccaagaccacccatataaaacatgggcctaccatggcagctacgaaacaaaacagactggatcagcatcatccatggtgaatggagtagttagactgctgacaaagccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccaaatggctctggaaagaactaggaaagaaaaagacacctaggatgtgcactagagaagaattcacaagaaaagtgagaagtaatgcagccctaggtgccatattcactgatgagaacaagtggaagtcggcacgtgaggctgttgaagacagtagattttgggaactggttgacaaggaaaggaatctccatcttgaaggaaagtgtgagacatgtgtgtacaacatgatgggaaagagagagaagaagataggggaatttggcaaagcaaaaggcagcagagccatatggtacatgtggcttggagcacgcttcttagagtttgaagccctaggattcttgaatgaagatcactggttttccagagagaactctctgagtggagtggaaggagaagggctgcacaagttgggttacattctaagagaagtgagcaagaaagaaggaggagcaatgtacgccgacgacactgcaggatgggacacaagaatcacactagaggacttaaaaaatgaagaaatggtgacaaaccacatggaaggagaacacaagaaacttgctgaggccatttttaaattaacgtaccaaaacaaggtggtgcgtgtgcaaagaccgacaccaaaaggcacagtaatggatattatatcgagaagagaccaaagaggtagtggacaagttggcacttatggccttaacacttttaccaatatgggagcccaactaatcagacagatggagggagaaggagtctttaaaggcatccagcacctgacagccacagaagaaattgcagtgcaagactggttagcaagagtggggcgtgagaggttatcaagaatggccatcagtggagatgattgtgttgtgaaacccttagatgacaggtttgcaagcgctttaacagctctaaatgacatgggaaaggttaggaaagacatacaacaatgggaaccttcaagaggatggaacgattggacacaagtgcctttctgttcacaccatttccatgagttaatcatgaaagacggtcgtgtactcgtagttccatgtagaaaccaagacgaactgattggtagagctcgaatttcccagggagccgggtggtctttgcgggagacggcctgtctggggaagtcttacgcccaaatgtggagcttgatgtacttccacagacgtgacctcaggctggcggcaaacgctatttgctcggcagtcccatcacattgggttccaacaagtcggacaacctggtccatacacgccagacatgaatggatgacaacagaagacatgctgacagtctggaacagggtgtggattcaagagaacccatggatggaagacaaaactccagtggaatcatgggaggaaatcccatacttggggaaaagagaagaccaatggtgcggctcactgatagggctaacaagcagggccacctgggcaaagaacatccaaacagcaataaaccaagttagatccttaataggcagtgaggaatacacagactatatgccatccatgaaaagattcagaagagaagaggaagaggcaggggtcttgtggtag

SEQ ID NO: 666 - DNA, 10176 bp, Dengue virus
atgaataaccaacggaaaaaggcgagaaatacgcctttcaatatgctgaaacgcgagagaaaccgcgtgtcaactgtgcaacagctgacaaagagattctcacttggaatgctgcagggacgaggaccgttgaaactgttcatggccctggtggcattccttcgtttcctaacaatcccaccaacagcagggattctaaaaagatggggaacgatcaaaaagtcaagggccatcaatgtcttgagagggttcaggaaagagattggaaggatgctgaacatcttgagtaggagacgcagaactgcaggcatgatcatcatgttgattccaacagcaatggcgttccatttaaccacacgcaacggagaaccacacatgatcgtcagtagacaagagaaagggaaaagtctcttgttcaaaacagaggatggtgtgaacatgtgtaccctcatggccatggaccttggtgaactgtgtgaagacacaatcacttataactgtcctcttctcaggcagaatgaaccagaagatatagattgttggtgcaactccacgtccacatgggtaacttatgggacatgcactgccacaggagaacacagaagggaaaaaagatcagtggcactcgtcccacatgtgggaatgggactggagacacgaactgaaacatggatgtcatcagaaggggcctggaaacacgcccagagaattgaaacctggatcttgagacatccaggttttaccataatggcagcaatcttggcatacaccataggaacgacatatttccaaagagtcctgatcttcatcttactgacagctgtcgctccttcaatgacaatgcgttgtagtggaatatcaaatagagactttgtggaaggggtttcaggaggaagctgggttgacatagtcttagaacatggaagctgtgtgacaacaatggcaaaaaacaaaccaacattggactttgaactgataaaaacagaagctaagcatcctgccactctaaggaagtactgtatagaggcaaggctgaccaacacaacaacagcatctcgatgcccaacacaaggggaacccagcctaaatgaagagcaggacaaaaggttcgtctgcaaacattccatggtagatagaggatggggaaatggatgtggattatttggaaagggaggcatcgtgacctgtgctatgttcacatgcaaaaagaacatggaaggaaaaatcgtgcaaccagaaaacctggaatacaccattgtagtaacacctcactcaggggaagagaatgcagttggaaatgacacaggaaaacatggcaaggaaatcaaagtgacaccacagagttccattacagaagcagaactgacaggctatggcactgtcacgatggagtgctctccaagaacgggcctcgacttcaatgagatggtgttgctgcaaatggaaaataaagcttggctggtgcacaggcaatggttcttagacctgccgttaccatggttgcccggagcggacacacaaggatcaaattggatacagaaggagacattggtcaccttcaaaaatccccatgcgaagaaacaggatgttgttgttttaggatcccaagaaggggctatgcatacagcacttacaggggccacggaaatccagatgtcatcaggaaacctattgttcacaggacatctcaagtgcaggctgagaatggacaaactacagctcaaaggaatgtcgtattctatgtgtacaggaaagtttaaagttgtaaaggaaatagcagaaacacaacatggaacaatagttatcagagtacagtatgaaggagatggctctccatgtaaaatcccttttgagataatggatttggaaaaaagacatgtcttaggtcgcctgattacagtcaacccaatcgtcacagaaaaagacagtccagtcaacatagaagcagaacctccattcggagacagctacatcattataggagtagaaccgggacaactgaagctcagctggtttaagaaaggaagctcaatcggccaaatgttcgagacaacaatgagaggagcgaagagaatggccattttaggtggcacagcctgggattttggatccctgggaggagtgttcacatctataggaaaggccctccaccaagtttttggagcaatctatggggctgccttcagtggggtctcatggactatgaaaatcctcataggagttgtcatcacatggataggaatgaattcacgtagcacctcactgtctgtgtcattagtattagtgggagtcgtgacattgtatttgggagccatggtgcaggctgatagtggttgtgttgtgagttggaaaaacaaagaactgaaatgtggcagtgggatttttatcacagacaatgtacacacatggacagaacaatacaaattccaaccagaatccccctcaaaactggcttcagctatccagaaagctcatgaagagggcatttgcggaatccgcttagtaacaagactggagaatctaatgtggaaacaaataacaccagaactgaatcacattctatcagaaaatgaggtaaagttgactatcatgacaggagacatcaaaggaattatgcaggcaggaaaacgatccctgcggcctcagcccactgagctgaagtattcatggaaaacatggggcaaagcgaaaatgctctccacagagcctcataaccagacctttctcattgatggccccgaaacagcagaatgtcccaacacaaacagagcttggaactcactagaagttgaagactatggcttcggggtattcaccaccaacatatggctgaagttgaaagaaaggcaggatgtgttttgtgactcaaaactcatgtcagcggccataaaaaacaacagagccgtccatgccgatatgggttattggatagaaagcgcccttaatgacacatggaagatagaaaaagcttctttcatcgaagttaaaagctgccactggccaaaatcacacactctctggagtaatggagtgctagaaagtgagatgataattccaaagaattttgctggaccagtatcacaacataattacagaccaggctattacacacaaacggcaggaccctggcatctaggcaagcttgagatggactttgatttttgtgaaggaaccacagtggtggtgactgaggactgtggaaatagagggccctctctaagaacaactaccgcctctggaaagctcataacagaatggtgttgccgatcctgcacattaccaccactaagatacagaggtgaggatggatgctggtacggaatggaaatcagaccattgaaagagaaagaagagaacttggtcaactctttggtcacagccggacatggacagattgacaacttctcactaggagtcttgggaatggcactgttcctggaagaaatgctcaggacccgagtaggaacaaaacatgcagcattactagttgcagtttctttcatgacattgatcacagggaacatgtctttccgagacctggggagagtgatggttatggtgggggctgctatgacggatgacataggtatgggcgtgacttatctcgccttactagcagctttcaaagttagaccaacttttgcagctggactacttttgagaaagctgacctccaaggaattgatgatgaccaccataggaatcgtactcctctcccagagcaccataccagagactatacttgaactgactgatgcgttggccttgggcatgatgatcctcaagatagtgagaaatatggaaaagtatcaattagcagtgaccatcatggctatcttatgtgttccaaatgcagtgatattacaaaatgcatggaaagtgagctgcacaatactggcagtggtgtccgtttccccactgctcttaacatcttcacagcagaaagcagattggataccattggcattgacgatcggaggtctcaatccaacagccattttcctaacaaccctttcaagaactaacaagaaaaggagttggccattaaatgaggctatcatggcagtcgggatggtgagcattttagccagttctctcttgaagaatgacattcccatgacaggaccattagtggctggagggcttctcactgtgtgttacgtgctcactggaagatcggctgacttggaactggagagagccgccgacgtaagatgggaagatcaggcagagatatcaggaagcagtccaattctgtcaataacaatatcggaagatggcagcatgtcgataaaaaatgaagaggaagaacaaacactgaccatactcattagaacaggattgctggtaatatcaggactttttcccatatcaataccaatcacggcagcggcatggtacctgtgggaagtgaagaaacaacgggctggagtattgtgggatgttccttcacccccacctgtgggaaaggccgaactggaggatggagcttatagaatcaagcagaaagggattcttggatactcccagatcggagctggagtttacaaagaaggaacattccatacaatgtggcacgtcacacgtggtgctgttctaatgcataaagggaagaggattgaaccatcatgggcggatgtcaggaaagacctaatatcgtatggaggaggctggaagttagaaggagaatggaaggaaggagaagaagtccaggtcttggcattagagcctggaaagaatccaagagccgtccaaacaaaacccggtctttttaaaactaacaccggaaccataggcgctgtatctctagacttttctcccggaacgtcaggatctccaatcgccgacaaaaaaggaaaagtcgtgggtctttatggcaatggtgtcgtcacaaggagtggaacatatgtgagtgccatagcccagactgaaaaaagcattgaagacaatccagagattgaagatgacatctttcggaaaaaaagattgaccattatggacctccacccaggagcgggaaagacgaaaagataccttccagcaatagtcagagaggccataaaacgaggcttgagaacattaatcctggcccccactagagtcgtggcagctgaaatggaggaagctcttagaggacttccaataagataccaaaccccagccatcagagctgagcacactgggcgagaaatcgtggatttaatgtgtcatgccacattcaccatgaggctgttatcaccagttagagtgccaaattacaacttgatcatcatggatgaagctcatttcacagacccagcaagcatagcagctagaggatacatttcaactcgagtagagatgggtgaagcagctgggattttcatgacagccactcctccgggaagcagggatccctttcctcagagcaatgcaccaatcatggatgaagaaagggaaatccctgaacgttcgtggaattctggacatgagtgggttacagattttaaagggaagactgtttggtttgtcccgagcataaaagcaggaaatgatatagcagcttgcctgagaaaaaatggaaagaaagtgatacaactcagtaggaagacctttgattctgaatatatcaagactaggaccaatgattgggactttgtggacacgactgacatttcagaaatgggtgctaattttaaagctgaaagggtcatagaccccaggcgctgcatgaaaccagtcatactaacagacggtgaagagcgggtgatcctggcaggacccatgccagtgacccactctagtgcagcacaaagaagagggagaataggaagaaatccaaaaaatgaaaacgaccagtacatatacatgggagaacctctggaaaatgatgaagactgtgcacactggaaagaagccaagatgcttctagacaatatcaacacgcctgaaggaatcattcccagcatgttcgaaccagagcgtgaaaaggtggatgccattgatggtgaataccgcttaagaggagaagcgaggaaaacctttgtggacctaatgagaagaggagacctgccagtctggctggcctacagagtggcagccgaaggcattaactatgcagacagaaggtggtgttttgatggaatcaagaacaaccaaatcttggaagaaaacgtggaagtggaaatctggacaaaagaaggggaaaggaagaaattgaaacccagatggttggatgctaggatctactctgacccgctggcgcttaaagaattcaaagagtttgcagccggaagaaaatccctgaccctgaatttaatcacagaaatgggtaggcttccaacttttatgactcagaaagcaaggaacgcactggacaacttagcagtcctgcatacggctgaagcaggcggaagggcgtacaatcatgctctcagtgaactgccagagaccctggagacattgcttttgctgacacttttggctacagtcacgggtggaatttttttattcttgatgagtggaaaaggtatagggaaaatgaccctgggaatgtgctgcataatcacggccagtattctcctatggtacgcacaaatacagccacactggatagcagcttcaataatactggagttttttctcatagttttactcattccagagccagaaaagcagagaacaccccaagataaccaattgacttacgttgtcatagccatcctcacagtggtggccgcaaccatggcaaacgagatggggttcctggaaaaaacgaagaaagatttcggattgggaagcattgcaacccagcaacccgagagcaacatcctggacatagatctacgtcctgcatcagcatggaccctgtatgcagtggccacaacatttatcacaccaatgttgagacatagcattgaaaattcctcagtgaatgtgtctctaacagccattgccaaccaagccacagtgctaatgggtcttgggaaaggatggccattgtcaaaaatggacattggagttccccttctcgccatcgggtgctattcacaagtcaaccccataactctcacagcagcccttcttttattggtagcacactatgctatcatagggccaggactccaagcgaaagcaaccagagaagcgcggaaaagagcagcagcaggcatcatgaaaaacccgactgtggatggaataacagtgattgacctagatccaataccctatgatccaaagtttgagaagcagctgggacaagtaatgctcctagtcctctgcgtgactcaagtactgatgatgaggactacatgggctttgtgtgaagctctaaccttagcgaccgggcccatctccacattgtgggaaggaaatccagggagattttggaatacaactattgcagtgtcaatggctaacatctttagaggaagttacttggctggagctggacttctcttttctatcatgaagaacacaaccaacacaagaaggggaactggcaacacaggagagacgcttggagagaaatggaaaaaccgattgaatgcattggggaagagtgaattccagatctacaagagaagcggaatccaggaagtggatagaaccttggcaaaagaaggcattaaaagaggagaaacggaccatcatgctgtgtcgcgaggctcagcaaagctgagatggttcgtcgagagaaacctggttacaccagaggggaaagtagtggacctcggttgcggcagagggggctggtcatactattgtgggggtctaaagaatgtaagagaagtcaaaggcctaacaaaaggaggaccaggacacgaagaacccattcccatgtcaacatatgggtggaatctcgtgcgtctccaaagtggagttgatgttttctttactccgccagaaaagtgtgacacattgttgtgtgacataggggagtcgtcaccaaatcccacggttgaagcaggacgaacactcagagtcctaaacttggtagaaaattggctgaacaacaacacccaattttgcataaaggttcttaacccatacatgccctcagttatagaaaaaatggaagcgctgcaaaggaaatacggaggagctttggtgaggaatccactctcaagaaattccacacatgagatgtattgggtatccaatgcttccgggaacatagtgtcatcagtgaacatgatttcaaggatgttgatcaacagatttacaatgagacataaaaaagccacatacgagccagatgttgacctcggaagcggaactcgcaacatcggaattgaaagtgagacaccaaacctagacataattgggaaaagaatagaaaaaataaaacaagagcatgagacatcatggcactatgaccaagaccacccatataaaacatgggcctaccatggcagctacgaaacaaaacagactggatcagcatcatccatggtgaatggagtagttagactgctgacaaagccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccaaatggctctggaaagaactaggaaagaaaaagacacctaggatgtgcactagagaagaattcacaagaaaagtgagaagtaatgcagccctaggtgccatattcactgatgagaacaagtggaagtcggcacgtgaggctgttgaagacagtagattttgggaactggttgacaaggaaaggaatctccatcttgaaggaaagtgtgagacatgtgtgtacaacatgatgggaaagagagagaagaagacaggggaatttggcaaagcaaaaggcagcagagccatatggtacatgtggcttggagcacgcttcttagagtttgaagccctaggattcttgaatgaagatcactggttttccagagagaactctctgagtggagtggaaggagaagggctgcacaagctgggttacattctaagagaagtgagcaagaaagaaggaggagcaatgtacgccgacgacactgcaggatgggacacaagaatcacactagaggacttaaaaaatgaagaaatggtgacaaaccacatggaaggagaacacaagaaacttgctgaggccatttttaaattaacgtaccaaaacaaggtggtgcgtgtgcaaagaccgacaccaaaaggcacagtaatggatattatatcgagaagagaccaaagaggtagtggacaagttggcacttatggccttaacacttttaccaatatgggagcccaactaatcagacagatggagggagaaggagtctttaaaggcatccagcacctgacagccacagaagaaattgcagtgcaagactggttagcaagagtggggcgtgagaggttatcaagaatggccatcagtggagatgattgtgttgtgaaacccttagatgacaggtttgcaagcgctttaacagctctaaatgacatgggaaaggttaggaaagacatacaacaatgggaaccttcaagaggatggaacgattggacacaagtgcctttctgttcacaccatttccatgagttaatcatgaaagacggtcgtgtactcgtagttccatgtagaaaccaagacgaactgattggtagagctcgaatttcccagggagccgggtggtctttgcgggagacggcctgtctggggaagtcttacgcccaaatgtggagcttgatgtacttccacagacgtgacctcaggctggcggcaaacgctatttgctcggcagtcccatcacattgggttccaacaagtcggacaacctggtccatacacgccagacatgaatggatgacaacagaagacatgctgacagtctggaacagggtgtggattcaagagaacccatggatggaagacaaaactccagtggaatcatgggaggaaatcccatacttggggaaaagagaagaccaatggtgcggctcactgatagggctaacaagcagggccacctgggcaaagaacatccaaacagcaataaaccaagttagatccttaataggcagtgaggaatacacagactatatgccatccatgaaaagattcagaagagaagaggaagaggcaggggtcttgtggtag

SEQ ID NO: 667 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgttatgttgattccaacagcgatggcgttccatctaaccacacgcaatggagaaccacacatgatcgttggcaggcaggagaaagggaaaagtcttctgttcaaaacagaggatggtgttaacatgtgtaccctcatggccatagaccttggtgaattgtgtgaagatacaatcacgtacaagtgtcctttccttagacaaaatgaacctgaagacatagattgttggtgcaactttacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcctactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaactacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtacagccagaaaatttggaatacaccatcgtgataacacctcactcaggagaagagcacgctgtaggcaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgccaagaaacaggatgttgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccgatcgtaacagaaaaagatagcccagtcaacatagaagcagaacctccattcggagacagctacatcatcataggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactaaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgctgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttacgaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggactcgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccatgccagagaccattcttgaactgactgatgcgttagccttgggcatgatggtcctcaaaatagtgagaaatatggaaaaataccaattagcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacttaatatcatatggaggaggctggaagctagaaggagaatggaaggaaggagaggaagtccaagtcctggcattggaacctggaaaaaatcccagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcacgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagtagagacccatttcctcagagcaatgcaccaatcatggatgaggaaagagaaatccctgagcgttcgtggaattcaggacatgaatgggtcacggattttaaagggaaaactgtttggtttgttccaagtataaaagcaggaaatgacatagcagcttgtcttaggaaaaatggaaagaaagtgatacaactcagcaggaagacttttgactctgagtatgttaagactagagccaatgattgggactttgtggtcacaactgacatttcagaaatgggtgctaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaatacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagcagcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattgcaacccaggaatctgagagcaacatcctggacatagatctacgtcctgcatcagcatggacgctgtatgccgtagctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggtatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattgaacgcactgggaaaaagtgaatttcagatctacaagaaaagtggaatccaggaagtggatagaaccctagcaaaagaaggtatcaaaagaggagaaacggaccaccatgctgtgtcacgaggatcagcaaaactgagatggttcgtcgagagaaatatggtcacaccggaagggaaggtggtggatctcggttgcggcagagggggatggtcatactattgtgggggactaaagaatgtaagagaagtcaaaggcctaacaaaaggaggaccaggacacgaagaacctatccccatgtcaacatatgggtggaatctagtgcgtctgcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaactcgcaacattggaattgaaagtgagataccaaatctagacataataggaaagagaatagagaaaataaaacaagagcatgaaacatcatggcattatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacggcaggatgggacacaagaatcacactagaagacttaaaaaatgaagaaatggtaacaaaccacatgaaaggagaacacaagaaactagccgaggccatattcaaattaacgtaccaaaacaaggtagtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcctgtttggggaagtcttacgcccaaatgtggaccctgatgtacttccacaaacgtgacctcagactggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccagacagcaataaatcaagtcagatcccttataggcaatgaggaatacacagattacatgccatccatgaagagattcagaagggaagaggaagaggcaggtgtcctgtggtag

SEQ ID NO: 668 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcaaggacgaggaccattaaaattgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaagataccttccggccatagtcagagaagctataaaacggggtttgagaacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggcggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgtgacacattgttgtgtgacataggggagtcatcaccaaatcccacagtggaagcaggacgaacactcagagtccttaatttagtagaaaattggctgaacaacaacactcaattctgcataaaagttctcaacccatatatgccctcagttatagaaaaaatggaagcactgcaaaggaaatatggaggagccttagtgagaaatccactctcacggaactccacacatgagatgtactgggtatccaatgcttccgggaacatagtgtcatcagtgaacatgatttcaagaatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccttaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 669 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcaaggacgaggaccattaaaattgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaaaataccttccggccatagtcagagaagctataaaacggggtttgagaacattaatcttggcccccaccagagtcgtggcagctgaaatggaggaagctctcagaggacttccaataagataccaaaccccagccatcagagctgagcacactgggcgggaaattgtggatctaatgtgtcacgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgaggggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggcggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctctttaccattatgaagaacacaaccaacacaagaaggggaactggcaacataggagagacgcttggagagaaatggaaaagccgactgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgtgacacattgttgtgtgacataggggagtcatcaccaaatcccacagtggaagcaggacgaacactcagagtccttaatttagtagaaaattggctgaacaacaacactcaattctgcataaaagttctcaacccatatatgccctcagttatagaaaaaatggaagcactgcaaaggaaatatggaggagccttagtgagaaatccactctcacggaactccacacatgagatgtactgggtatccaatgcttccgggaacatagtgtcatcagtgaacatgatttcaagaatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccttaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 670 - DNA, 10176 bp, Dengue virus
atgaataaccaacggaaaaaggcgagaaatacgcctttcaatatgctgaaacgcgagagaaaccgcgtgtcaactgtgcagcagctgacaaagagattctcacttggaatgctacagggacgaggaccattgaaactgttcatggccctggtggcattccttcgtttcctaacaatcccgccaacagcagggatattaaaaagatggggaacaatcaaaaaatcaaaggctatcaatgtcttgagagggttcaggaaagagattggaaggatgctgaacatcttgaacaggagacgcagaactgcaggtataattattatgatgattccaacagtgatggcgttccatttaaccacacgcaacggagaaccacacatgatcgtcagtagacaagagaaggggaaaagtcttctgtttaaaacagagaacggtgtgaacatgtgtaccctcatggccatggaccttggtgaattgtgtgaagacacaatcacttataattgtcctcttctcaggcagaatgaaccagaagacatagactgtgggtgccactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcaccataatggcagcaatcctggcatacaccataggaacgacatatttccaaagagtcctgattttcatcttactgacagctgtcactccttcaatgacaatgcgttgtataggaatatcaaatagggactttgtggaaggggtttcaggaggaagctgggttgacatagtcttggaacatggaagctgtgtgacgacgatggcgaaaaataaaccaacattggattttgaactggtaaaaacagaagccaaacatcccgccactctaaggaagtattgtatagaagcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgttacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattatatttgggagttatggtgcaggccgatagtggctgcgttgtgagttggaaaaacaaagaactgaaatgtggcagtgggatttttatcacagacaacgtgcacacatggacagaacaatacaaattccaaccagaatccccttcaaagctggcttcagctatccagaaggctcatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaattgaaagaaaggcaggatgtattttgtgactcaaaactcatgtcagcagccataaaagacaacagagccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggtaggcttgagatggactttgatttctgcgaaggaaccacagtggtagtgactgaggactgtggaaacagaggaccctctttaagaacaactactgcttctggaaaactcataacagaatggtgctgccgatcctgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatctcgccctattagcagccttcaaagtcagaccaactttcgcagctggactactcttaagaaagctgacctccaaggaattgatgatgaccaccataggaatcgtactcctctctcagagcaccataccagagactatacttgaactgactgacgcgtgggctttggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattagaacaggactgctggtgatatcaggactttttcccgcgtcaataccaatcacggcagctgcatggtacctgtgggaagtgaaaaaacaacgagccggagtattgtgggatgtcccttcacccccacctgtgggaaaggccgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtatctctggacttctctcctggaacgtcaggatctccaattgtcgacaaaaaaggaaaagttgtgggcctttatggcaacggtgtcgtcacaaggagtggagcatatgtgagtgccatagcccagactgaaaaaagcatcgaagacaatccagagattgaagatgacatctttcgaaagaaaagattgaccatcatggacctccacccaggagcgggaaaaacaaagagataccttccagcaatagttagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctgctatcaccaattagagtgccaaattacaacctgatcatcatggatgaagcccatttcacagacccagcaagcatagcagctagaggatacatttcaactcgagtagagatgggtgaagcagctgggattttcatgacagctactcctcctggaagcagagacccatttcctcagagcaatgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggctgagagggttatagaccccagacgctgcatgaaaccagtcatactaactgacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggatgccattgatggtgaataccgcttgagaggagaagcgaggaaaacttttgtggacctaatgagaagaggagacctaccagtctggctagcctacagagtggctgctgaaggtatcaactacgcagacagaagatggtgctttgatggagtcaagaacaaccaaatcttggaagaaaatgtggaagtggaaatttggacaaaagaaggagaaaggaagaaattaaaacccagatggttggatgccaggatctactctgacccactggcgctcaaagaattcaaggaattcgcagctggaagaaagtccctgactctgaatctaatcacagagatgggtaggctcccaaccttcatgacccagaaagcaaggaatgcactggacaacttagcagtcctgcatacggctgaagcaggcggaagggcgtacaatcatgctcttagtgaactgccggagaccctggagacattgcttttactgacacttttggccacagtcacgggcggaatcttcctgttcttgatgagcggaaagggtatagggaagatgaccctgggaatgtgctgcataatcacggccagtattctcctatggtatgcacaaatacagccacactggatagcagcctcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaagcattgcaacccagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcacggcagcccttctcttattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgacccaagtattgatgatgaggactacatgggctttatgtgaagctctaaccttagcgaccgggcccatctctacactgtgggaaggaaatccagggagattttggaatacaactattgcagtgtcaatggctaacatttttagagggagttacctggccggagccggacttctcttttctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgttttttttactccgccagaaaagtgtgacacattactgtgtgacataggggagtcgtcaccaaaccccacggttgaggcaggacgaacactcagagttctaaacttagtggaaaattggctgaacaacaacacccaattttgcataaaggttctcaacccatatatgccctcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagcggaacccgcaacatcggaattgaaagtgagacaccaaatttagacataattgggaaaagaatagagaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacatcatccctatggtgacacagatggcaatgacagacacgactccatttgggcaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcacctgacagtcacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtactcgtagttccatgtagaaaccaagatgaactgattggtagggcccgaatttcccagggagccgggtggtccttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 671 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaacaggagacgcagatctgcaggcatgatcattatgctgattccaacagtaatggcgttccatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacatccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccctcaatgacaatgcgttgcataggaatatcaaatagagactttgtagaaggagtttcaggaggaagctgggttgacatagtcttagaacatggaagctgtgtgacgacgatggcaaaaaacaaaccaacattggattttgaactgataaaaacggaagccaaacagcctgctaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacgccacagagttccatcacagaagcagaattgacaggttatggcaccgtcacgatggagtgctctccgagaacaggcctcgacttcaatgagatggtgttgctgcagatggaaaataaagcttggctggtgcataggcaatggtttctagacctgccattaccatggctgcccggagcggatacacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttactcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagttctatcggccaaatgtttgagacaacaatgaggggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtattggtgggaattgtgacactgtatttgggagtcatggtacaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacagcagaatgccccaatacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaagcctccttcattgaagtaaaaaactgccactggccaagatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttggattctgcgatggaaccacagtggtagtgactgaggactgtggaaatagaggaccctctttgagaacaactactgcctctggaaaactcataacagaatggtgctgccgatcttgcacattaccacccctaagatacagaggtgaggatgggtgctggtacgggatggaaatcagaccattaaaagagaaagaagaaaatttggttaactccttggtcacagccggacatgggcaggttgacaatttttcactaggagtcttgggaatggcattgttcctggaggaaatgctcaggacccgagtaggaacgaaacatgcaatactactagttgcagtttcttttgtgacattgatcacagggaacatgtcctttaaagacctaggaagagtggtggttatggtaggcgccgccatgacggatgacataggtatgggggtaacttatcttgccctactagccgccttcaaagtcagaccaacttttgcagctggactactcttgaaaaagctgacctccaaggaattgatgatgactaccataggaattgtactcctctcccaaagcactataccagagaccattcttgaattgactgatgcgttagccttaggcatgatggtcctcaaaatagtaagagacatggaaaagtatcaattagcagtgactatcatggctatcttgtgcgtcccaaacgcagtgatattacaaaatgcatggaaagcgagttgcacaatactagcagtggtgtccgtttccccactgcttttgacatcctcacagcaaaaaacggattggataccattagcattgacaatcaagggcctcaatccaacagccatttttctaacaaccctctcaagaaccaacaagaaaaggagctggccactaaatgaggctatcatggcagtcggaatggtgagcattttagccagttctctcctaaaaaatgatattcccatgacaggaccactagtggctggagggctcctcactgtgtgctacgtgctcactggacgatcggccgacttggaactggagagagcaaccgatgtcaaatgggaagaccaagcagagatatcaggaagcagtccaatcctgtcaataacaatatcagaagatggtagcatgtcgataaaaaatgaagaggaagaacaaacactgaccatactcattagaacaggattgctggtgatctcaggacttttccctgtatcaataccaatcacggcagcagcatggtacctgtgggaagtgaagaaacaacgggccggagtattgtgggatgttccttcacccccacccataggaaaggctgaactggaagatggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagctagaaggagaatggaaggaaggagaagaagtccaggtgctggcattggaacctggaaaaaatccaagagccgtccaaacaaaacctggtctcttcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaacccagagatcgaagatgacattttccgaaagagaagactgaccatcatggacctccacccaggagcgggaaagacgaaaagataccttccggctatagtcagagaagctataaaacggggtttgagaacattaatcttggcccccaccagagttgtggcagctgaaatggaggaagctctcagaggacttccaataagataccaaaccccagccatcagagctgagcacacagggcgggaaattgtggatctaatgtgtcatgccacatttaccatgaggctgctatcaccagttagagtgccaaactacaacctgatcatcatggatgaagcccatttcacagacccagcaagtatagcagctagaggatacatctcaactcgagtggagatgggtgaggcagctgggattttcatgacagccactcccccgggaagcagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgccaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacattaacacaccagaaggaatcattcccagtatgtttgaaccagagcgcgaaaaagtggatgccattgatggcgagtaccgcttgagaggagaagcaaggaaaacctttgtggacttaatgagaagaggagacctaccagtctggctggcctacaaagtggcagctgaaggcatcaactatgcagacagaaggtggtgttttgatggaatcaagaacaaccaaatcctggaagagaatgtggaagttgaaatctggacaaaagaaggggaaaggaagaaattgaaacccagatggctggatgctaggatctactctgacccactggcgctaaaagaattcaaagaatttgcagccggaagaaagtctctgaccctgaacctaattacagaaatgggtaggcttccaacattcatgactcagaagacaagagacgcactggacaacttagcagtgctgcacacggctgaagcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgcataattacggctagcatccttctatggtacgcacaaatacagccacactggatagcagcttcaataatactggagttttttctcatagttttgcttattccagaaccagaaaaacagagaacaccccaagacaaccaattgacctatgtcgtcatagccatcctcacagtggtggccgcaactatggcaaatgagatgggtttcctagaaaaaacgaagaaagatcttggattaggaagcattgcaacccagcaacccgagagcaacatcctggacatagatctacgccccgcatcagcatggacgctgtatgccgtggctacaacatttgttacaccaatgctgagacatagcattgagaactcctcagtgaatgtatccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggcatcatgaaaaacccaaccgtcgatggaataacagtgattgatctagatccaataccttatgatccaaagtttgaaaagcagttgggacaagtaatgctcctagttctttgcgtgactcaagtattgatgatgaggaccacatgggctctgtgtgaggccttaaccttggctaccgggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactaggaaaaagtgaattccagatctacaagaaaagtggaatccaggaagtggacagaaccttagcaaaagaaggcatcaaaagaggagaaacggaccatcacgctgtgtcgcggggctcagcaaaactgagatggttcgttgagagaaacatggtcacaccagaagggaaagtagtggatctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcaaagtggagttgacgttttcttcattccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaaacactgcaaaggaaatatggaggagccttagtgagaaacccactctcacggaactccacacatgagatgtactgggtatccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgcgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtttttaaaaacattcagcacctgacagtcacagaagaaatcgccgtgcaaaactggttagcaagagtggggcgcgaaaggttatcaagaatggccattagtggagatgattgtgttgtgaaacctttagatgacaggttcgcaagcgccctgacagctctaaatgacatgggaaagattagaaaagacatacaacaatgggaaccttcaagaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcctgatgtattttcacagacgcgacctcaggttggcggcaaatgccatttgctcggcagtgccatcacattgggttccaacaagtcgaacaacctggtccatacacgccaaacatgaatggatgacaacggaagacatgctgacagtctggaatagggtgtggatccaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 672 - DNA, 10176 bp, Dengue virus
atgaataaccaacgaaaaaaggcgaaaaatacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaaaagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtagacaagagaaagggaaaagtcttctgtttaaaacagaggatggcgtgaacatgtgcaccctcatggccatggaccttggtgaattgtgtgaagacacaatcacgtacaagtgtcccctcctcaggcagaatgagccagaagatatagactgttggtgcaactccacgtccacgtgggtaacctatgggacttgtgccaccacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtattgcatagaagcaaagctaaccaacacaacaacagaatctcgttgcccaacacaaggggaacccagcctaaaagaagagcaggacaagaggttcgtctgcaaacactccatggtagacagaggatgggggaatggatgtggattatttggaaagggaggcattgtgacctgtgccatgttcacatgcaaaaagaacatggaagggaaaatcgtgcaaccagaaaacttggaatacaccattgtggtaacaccccactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcatcaggaaacttactcttcactggacatctcaagtgcaggctgagaatggacaagctacagctcaaaggaatgtcatactctatgtgcacaggaaagttcaaagttgtgaaggaaatagcagaaacacaacatggaacgatagttatcagagtgcaatatgaaggggacggctccccatgtaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaattggtttaagaaaggaagttctatcggccaaatgtttgagacaacaatgaggggggcgaagagaatggccattttgggtgacacagcctgggatttcggatccctgggaggagtgtttacatctataggaaaagctctccaccaagtctttggagcaatctatggagcggccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgtcgtgagctggaaaaacaaagaactgaaatgtggcagtggaattttcatcacagacaacgtgcacacatggacagaacaatacaagttccaaccagaatccccttcaaaactggcctcagctatccagaaagctcaagaagagggaatttgtggaatccgctcagtaacaagattggagaatctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtcccataaccaaacctttctcattgatggccccgaaacagcagaatgccccaacacaaatagagcttggaactcgctggaggttgaagactacggctttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctatcatacacaaatagcaggaccatggcatctaggtaagcttgagatggactttgatttctgcgaaggaactacagtggtagtgactgaggactgcggaaatagaggaccctctttgagaacaaccactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactaggagtcttgggaatggcattgttcctggaggaaatgcttaggacccgagtaggaacgaaacatgcaatactactagttgcagtttcttttatgacattgatcacagggaacatgtccttcaaagacctaggaagagtggtggttatggtaggcgccgccatgacggatgacataggcatgggcgtgacttatcttgccctactagcagccttcaaagttagaccaacttttgcagctggactactcctgagaaagctgacctccaaggaattgatgatgactaccataggaattgtactcctctcccaaagcaccataccagagaccattcttgaattgactgatgcgttagccttaggcatgatggtcctcaaaatggtaagaaacatggaaaagtatcaattagcagtgaccatcatggctatcttgtgtgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccagcaagaaaaggagctggccactaaatgaggctatcatggcagtcggaatggtgagcattttagccagttctctcctaaaaaatgatattcccatgacaggaccactagtggctggagggctcctcactgtgtgctacgtgctcactggacgatcggccgacttggaactggagagagcgaccgatgtcaaatgggaagaccaggcagagatatcaggaagcagtccaatcctgtcaataacaatatcagaagatggtagcatgtcgataaaaaatgaagaggaagaacagacactgaccatactcattagaacaggattgctggtgatctcaggactttttcctgtatcaataccgatcacggcagcagcatggtacctgtgggaagtgaagaaacaacgggccggagtattgtgggatgttccttcacccccacccatgggaaaggctgaactggaagatggagcctacagaatcaagcaaaaagggattcttggatattcccagatcggagctggagtttacaaagaaggaacattccatacaatgtggcatgtcacacgtggcgctgtcctaatgcacaaaggaaagaggattgaaccgtcatgggcggacgtaaaaaaagatctaatatcatatggaggaggctggaagttagaaggagaatggaaggaaggagaagaagtccaggtgctggcattggagcctggaaaaaatccaagagccgtccaaacaaaacctggtcttttcaaaaccaacgccggaacaataggtgccgtatctctggacttttcccctggaacgtcgggatctccaatcattgacaaaaaaggaaaagttgtaggtctttatggtaatggtgttgttacaaggagtggagcatatgtgagtgctatagcccaaactgaaaaaagcattgaagacaacccagagatcgaagatgacatattccgaaagagaagactgaccatcatggacctccacccaggagcgggaaagacgaaaagataccttccggccatagtcagagaagctataaaacggggtttgagaacattaatcttggcccccaccagagtagtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggattttcatgacggccactcctccgggaagcagagatccatttcctcagagcaacgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaggctgagagggttatagaccccagacgttgcatgaaaccagtcatactaacagatggtgaggagcgggtgatcctggcaggacccatgccagtgacccactctagtgcagcacaaagaagagggagaatagggagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgagccagaacgtgaaaaagtggatgccattgatggcgaataccgcttgagaggagaagcaaggaaaacctttgtggacttgatgagaagaggagacctaccagtctggttggcctacaaagtggcagctgaaggcatcaactatgcagacagaaggtggtgttttgatggaatcaagaacaaccaaatcttggaagaaaatgtggaagttgaaatctggacaaaagaaggggaaaggaagaaattgaaacccagatggctggatgcaaggatctattctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgcataatcacggctagcatccttctatggtacgctcaaatacagccacactggatagcagcttcaataatactggagttttttcttatagttttgcttattccagaaccagaaaaacagagaacaccccaagacaatcaattgacctacgttgtcatagccatcctcacagtggtggccgcaaccatggcaaacgagatgggtttcctagaaaaaacgaagaaagatcttggactaggaagcattgtaacccagcaacccgagagcaacatcctggacatagatctacgccccgcatcagcgtggacgctgtatgccgtggccacaacatttgtcacaccaatgctgagacatagcattgagaattcctcagtgaatgtatccctaacagctatagccaaccaagcaacagtgttgatgggtctagggaaaggatggccgttgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcagctggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacaccaccattgcggtgtcaatggctaacatctttagagggagttacttggctggagctggacttctcttttccattatgaagaacacaaccaacacaagaaggggagctggcaacataggagagacgcttggagagaaatggaaaagccgattgaacgcactgggaaaaagtgaattccagatctacaagaaaagtggaattcaggaagtggatagaaccttagcaaaagaaggcatcaaaagaggagaaacggaccatcacgctgtgtcacgaggctcagcaaaactgagatggttcgttgagagaaatatggtcacaccagaagggaaagtagtggacctcggttgtggcagaggaggttggtcatactattgtggaggactaaaaaacgtaagagaagtgaaaggcctaacaaaaggaggaccaggacatgaagaacccatccccatgtcaacatatgggtggaacctagtgcgtcttcaaagtggagttgacgttttcttcatcccgccagaaaagtgtgacacattgttgtgtgacataggggagtcatcaccaaaccccacagtggaagcaggacgaacactcagagtccttaatttagtagaaaattggttgaacaacaacactcaattttgcataaaggttctcaacccatatatgccctcagttatagaaaaaatggaaacactgcaaaggaaatatggaggagccttagtgagaaatccactctcacggaactccacacatgagatgtactgggtatccaacgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaacttagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtccttcccatggtgacacagatggcaatgacagacacgactccatttggacaacagcgtgtctttaaagaaaaagtggacacgagaacccaagaaccgaaagaaggcacgaagaaactaatgaaaatcacggcagagtggctgtggaaagaattagggaagaaaaagacacctaggatgtgcaccagagaagaatttacaagaaaggtgagaagcaatgcagccttgggggccgtattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtaccaaaacaaggtggtgcgtgtgcaaagaccaacaccaagaggcacagtaatggacattatatcgagaagagaccaaagaggtagtgggcaagttggcacctatggactcaatactttcaccaacatggaagcccaattaatcagacagatggagggagaaggagtctttaaaaacattcagcacctgacagtcacagaagaaatcgctgtgcaaaactggttagcaagggtggggcgcgaaaggttatcaagaatggccatcagtggagatgattgtgttgtgaaacctttagatgacaggtttgcaagcgctttgacagctctgaatgacatgggaaagattagaaaagacatacaacaatgggaaccttcaagaggatggaacgattggacacaagtccccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcggtgccatcacattgggttccaacaagtcgaataacctggtccatacacgccaaacatgaatggatgacgacggaagacatgctgacagtctggaacagagtgtggattcaagaaaacccatggatggaagacaaaaccccagtggaatcatgggaggaaatcccatacttgggaaaaagagaagaccaatggtgcggctcactgattgggttaacaagcagggccacatgggcaaagaacatccaagcagcaataaatcaagttagatctctcataggcaatgaggaatacacagattatatgccatccatgaaaagattcagaagagaagaggaagaagcaggagtcctgtggtag

SEQ ID NO: 673 - DNA, 10176 bp, Dengue virus
atgaataaccaacgaaaaaaggcgaaaaatacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaaaagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtagacaagagaaagggaaaagtcttctgtttaaaacagaggatggcgtgaacatgtgcaccctcatggccatggaccttggtgaattgtgtgaagacacaatcacgtacaagtgtcccctcctcaggcagaatgagccagaagatatagactgttggtgcaactccacgtccacgtgggtaacctatgggacttgtgccaccacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtattgcatagaagcaaagctaaccaacacaacaacagaatctcgttgcccaacacaaggggaacccagcctaaaagaagagcaggacaagaggttcgtctgcaaacactccatggtagacagaggatgggggaatggatgtggattatttggaaagggaggcattgtgacctgtgccatgttcacatgcaaaaagaacatggaagggaaaatcgtgcaaccagaaaacttggaatacaccattgtggtaacaccccactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcatcaggaaacttactcttcactggacatctcaagtgcaggctgagaatggacaagctacagctcaaaggaatgtcatactctatgtgcacaggaaagttcaaagttgtgaaggaaatagcagaaacacaacatggaacgatagttatcagagtgcaatatgaaggggacggctccccatgtaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaattggtttaagaaaggaagttctatcggccaaatgtttgagacaacaatgaggggggcgaagagaatggccattttgggtgacacagcctgggatttcggatccctgggaggagtgtttacatctataggaaaagctctccaccaagtctttggagcaatctatggagcggccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgtcgtgagctggaaaaacaaagaactgaaatgtggcagtggaattttcatcacagacaacgtgcacacatggacagaacaatacaagttccaaccagaatccccttcaaaactggcctcagctatccagaaagctcaagaagagggaatttgtggaatccgctcagtaacaagattggagaatctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtcccataaccaaacctttctcattgatggccccgaaacagcagaatgccccaacacaaatagagcttggaactcgctggaggttgaagactacggctttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctatcatacacaaatagcaggaccatggcatctaggtaagcttgagatggactttgatttctgcgaaggaactacagtggtagtgactgaggactgcggaaatagaggaccctctttgagaacaaccactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactaggagtcttgggaatggcattgttcctggaggaaatgcttaggacccgagtaggaacgaaacatgcaatactactagttgcagtttcttttatgacattgatcacagggaacatgtccttcaaagacctaggaagagtggtggttatggtaggcgccgccatgacggatgacataggcatgggcgtgacttatcttgccctactagcagccttcaaagttagaccaacttttgcagctggactactcctgagaaagctgacctccaaggaattgatgatgactaccataggaattgtactcctctcccaaagcaccataccagagaccattcttgaattgactgatgcgttagccttaggcatgatggtcctcaaaatggtaagaaacatggaaaagtatcaattagcagtgaccatcatggctatcttgtgtgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccagcaagaaaaggagctggccactaaatgaggctatcatggcagtcggaatggtgagcattttagccagttctctcctaaaaaatgatattcccatgacaggaccactagtggctggagggctcctcactgtgtgctacgtgctcactggacgatcggccgacttggaactggagagagcgaccgatgtcaaatgggaagaccaggcagagatatcaggaagcagtccaatcctgtcaataacaatatcagaagatggtagcatgtcgataaaaaatgaagaggaagaacagacactgaccatactcattagaacaggattgctggtgatctcaggactttttcctgtatcaataccgatcacggcagcagcatggtacctgtgggaagtgaagaaacaacgggccggagtattgtgggatgttccttcacccccacccatgggaaaggctgaactggaagatggagcctacagaatcaagcaaaaagggattcttggatattcccagatcggagctggagtttacaaagaaggaacattccatacaatgtggcatgtcacacgtggcgctgtcctaatgcacaaaggaaagaggattgaaccgtcatgggcggacgtaaaaaaagatctaatatcatatggaggaggctggaagttagaaggagaatggaaggaaggagaagaagtccaggtgctggcattggagcctggaaaaaatccaagagccgtccaaacaaaacctggtcttttcaaaaccaacgccggaacaataggtgccgtatctctggacttttcccctggaacgtcgggatctccaatcattgacaaaaaaggaaaagttgtaggtctttatggtaatggtgttgttacaaggagtggagcatatgtgagtgctatagcccaaactgaaaaaagcattgaagacaacccagagatcgaagatgacatattccgaaagagaagactgaccatcatggacctccacccaggagcgggaaagacgaaaagataccttccggccatagtcagagaagctataaaacggggtttgagaacattaatcttggcccccaccagagtagtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggattttcatgacggccactcctccgggaagcagagatccatttcctcagagcaacgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaggctgagagggttatagaccccagacgttgcatgaaaccagtcatactaacagatggtgaggagcgggtgatcctggcaggacccatgccagtgacccactctagtgcagcacaaagaagagggagaatagggagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgagccagaacgtgaaaaagtggatgccattgatggcgaataccgcttgagaggagaagcaaggaaaacctttgtggacttgatgagaagaggagacctaccagtctggttggcctacaaagtggcagctgaaggcatcaactatgcagacagaaggtggtgttttgatggaatcaagaacaaccaaatcttggaagaaaatgtggaagttgaaatctggacaaaagaaggggaaaggaagaaattgaaacccagatggctggatgcaaggatctattctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgcataatcacggctagcatccttctatggtacgctcaaatacagccacactggatagcagcttcaataatactggagttttttcttatagttttgcttattccagaaccagaaaaacagagaacaccccaagacaatcaattgacctacgttgtcatagccatcctcacagtggtggccgcaaccatggcaaacgagatgggtttcctagaaaaaacgaagaaagatcttggactaggaagcattgtaacccagcaacccgagagcaacatcctggacatagatctacgccccgcatcagcgtggacgctgtatgccgtggccacaacatttgtcacaccaatgctgagacatagcattgagaattcctcagtgaatgtatccctaacagctatagccaaccaagcaacagtgttgatgggtctagggaaaggatggccgttgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcagctggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacaccaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaattcaggaagtggatagaaccttagcaaaagaaggcatcaaaagaggagaaacggaccatcacgctgtgtcacgaggctcagcaaaactgagatggttcgttgagagaaatatggtcacaccagaagggaaagtagtggacctcggttgtggcagaggaggttggtcatactattgtggaggactaaaaaacgtaagagaagtgaaaggcctaacaaaaggaggaccaggacatgaagaacccatccccatgtcaacatatgggtggaacctagtgcgtcttcaaagtggagttgacgttttcttcatcccgccagaaaagtgtgacacattgttgtgtgacataggggagtcatcaccaaaccccacagtggaagcaggacgaacactcagagtccttaatttagtagaaaattggttgaacaacaacactcaattttgcataaaggttctcaacccatatatgccctcagttatagaaaaaatggaaacactgcaaaggaaatatggaggagccttagtgagaaatccactctcacggaactccacacatgagatgtactgggtatccaacgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaacttagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtccttcccatggtgacacagatggcaatgacagacacgactccatttggacaacagcgtgtctttaaagaaaaagtggacacgagaacccaagaaccgaaagaaggcacgaagaaactaatgaaaatcacggcagagtggctgtggaaagaattagggaagaaaaagacacctaggatgtgcaccagagaagaatttacaagaaaggtgagaagcaatgcagccttgggggccgtattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtaccaaaacaaggtggtgcgtgtgcaaagaccaacaccaagaggcacagtaatggacattatatcgagaagagaccaaagaggtagtgggcaagttggcacctatggactcaatactttcaccaacatggaagcccaattaatcagacagatggagggagaaggagtctttaaaaacattcagcacctgacagtcacagaagaaatcgctgtgcaaaactggttagcaagggtggggcgcgaaaggttatcaagaatggccatcagtggagatgattgtgttgtgaaacctttagatgacaggtttgcaagcgctttgacagctctgaatgacatgggaaagattagaaaagacatacaacaatgggaaccttcaagaggatggaacgattggacacaagtccccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcggtgccatcacattgggttccaacaagtcgaacaacctggtccatacacgccaaacatgaatggatgacaacggaagacatgctgacagtctggaacagagtgtggattcaagaaaacccatggatggaagacaaaaccccagtggaatcatgggaggaaatcccatacttgggaaaaagagaagaccaatggtgcggctcactgattgggttaacaagcagggccacatgggcaaagaacatccaagcagcaataaatcaagttagatctctcataggcaatgaggaatacacagattatatgccatccatgaaaagattcagaagagaagaggaagaagcaggagtcctgtggtag

SEQ ID NO: 674 - DNA, 10176 bp, Dengue virus
atgaataaccaacgaaaaaaggcgaaaaatacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaaaagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtagacaagagaaagggaaaagtcttctgtttaaaacagaggatggcgtgaacatgtgcaccctcatggccatggaccttggtgaattgtgtgaagacacaatcacgtacaagtgtcccctcctcaggcagaatgagccagaagatatagactgttggtgcaactccacgtccacgtgggtaacctatgggacttgtgccaccacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtattgcatagaagcaaagctaaccaacacaacaacagaatctcgttgcccaacacaaggggaacccagcctaaaagaagagcaggacaagaggttcgtctgcaaacactccatggtagacagaggatgggggaatggatgtggattatttggaaagggaggcattgtgacctgtgccatgttcacatgcaaaaagaacatggaagggaaaatcgtgcaaccagaaaacttggaatacaccattgtggtaacaccccactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcatcaggaaacttactcttcactggacatctcaagtgcaggctgagaatggacaagctacagctcaaaggaatgtcatactctatgtgcacaggaaagttcaaagttgtgaaggaaatagcagaaacacaacatggaacgatagttatcagagtgcaatatgaaggggacggctccccatgtaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaattggtttaagaaaggaagttctatcggccaaatgtttgagacaacaatgaggggggcgaagagaatggccattttgggtgacacagcctgggatttcggatccctgggaggagtgtttacatctataggaaaagctctccaccaagtctttggagcaatctatggagcggccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgtcgtgagctggaaaaacaaagaactgaaatgtggcagtggaattttcatcacagacaacgtgcacacatggacagaacaatacaagttccaaccagaatccccttcaaaactggcctcagctatccagaaagctcaagaagagggaatttgtggaatccgctcagtaacaagattggagaatctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtcccataaccaaacctttctcattgatggccccgaaacagcagaatgccccaacacaaatagagcttggaactcgctggaggttgaagactacggctttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctatcatacacaaatagcaggaccatggcatctaggtaagcttgagatggactttgatttctgcgaaggaactacagtggtagtgactgaggactgcggaaatagaggaccctctttgagaacaaccactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactaggagtcttgggaatggcattgttcctggaggaaatgcttaggacccgagtaggaacgaaacatgcaatactactagttgcagtttcttttatgacattgatcacagggaacatgtccttcaaagacctaggaagagtggtggttatggtaggcgccgccatgacggatgacataggcatgggcgtgacttatcttgccctactagcagccttcaaagttagaccaacttttgcagctggactactcctgagaaagctgacctccaaggaattgatgatgactaccataggaattgtactcctctcccaaagcaccataccagagaccattcttgaattgactgatgcgttagccttaggcatgatggtcctcaaaatggtaagaaacatggaaaagtatcaattagcagtgaccatcatggctatcttgtgtgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccagcaagaaaaggagctggccactaaatgaggctatcatggcagtcggaatggtgagcattttagccagttctctcctaaaaaatgatattcccatgacaggaccactagtggctggagggctcctcactgtgtgctacgtgctcactggacgatcggccgacttggaactggagagagcgaccgatgtcaaatgggaagaccaggcagagatatcaggaagcagtccaatcctgtcaataacaatatcagaagatggtagcatgtcgataaaaaatgaagaggaagaacagacactgaccatactcattagaacaggattgctggtgatctcaggactttttcctgtatcaataccgatcacggcagcagcatggtacctgtgggaagtgaagaaacaacgggccggagtattgtgggatgttccttcacccccacccatgggaaaggctgaactggaagatggagcctacagaatcaagcaaaaagggattcttggatattcccagatcggagctggagtttacaaagaaggaacattccatacaatgtggcatgtcacacgtggcgctgtcctaatgcacaaaggaaagaggattgaaccgtcatgggcggacgtaaaaaaagatctaatatcatatggaggaggctggaagttagaaggagaatggaaggaaggagaagaagtccaggtgctggcattggagcctggaaaaaatccaagagccgtccaaacaaaacctggtcttttcaaaaccaacgccggaacaataggtgccgtatctctggacttttcccctggaacgtcgggatctccaatcattgacaaaaaaggaaaagttgtaggtctttatggtaatggtgttgttacaaggagtggagcatatgtgagtgctatagcccaaactgaaaaaagcattgaagacaacccagagatcgaagatgacatattccgaaagagaagactgaccatcatggacctccacccaggagcgggaaagacgaaaagataccttccggccatagtcagagaagctataaaacggggtttgagaacattaatcttggcccccaccagagtagtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggattttcatgacggccactcctccgggaagcagagatccatttcctcagagcaacgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaggctgagagggttatagaccccagacgttgcatgaaaccagtcatactaacagatggtgaggagcgggtgatcctggcaggacccatgccagtgacccactctagtgcagcacaaagaagagggagaatagggagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgagccagaacgtgaaaaagtggatgccattgatggcgaataccgcttgagaggagaagcaaggaaaacctttgtggacttgatgagaagaggagacctaccagtctggttggcctacaaagtggcagctgaaggcatcaactatgcagacagaaggtggtgttttgatggaatcaagaacaaccaaatcttggaagaaaatgtggaagttgaaatctggacaaaagaaggggaaaggaagaaattgaaacccagatggctggatgcaaggatctattctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgcataatcacggctagcatccttctatggtacgctcaaatacagccacactggatagcagcttcaataatactggagttttttcttatagttttgcttattccagaaccagaaaaacagagaacaccccaagacaatcaattgacctacgttgtcatagccatcctcacagtggtggccgcaaccatggcaaacgagatgggtttcctagaaaaaacgaagaaagatcttggactaggaagcattgtaacccagcaacccgagagcaacatcctggacatagatctacgccccgcatcagcgtggacgctgtatgccgtggccacaacatttgtcacaccaatgctgagacatagcattgagaattcctcagtgaatgtatccctaacagctatagccaaccaagcaacagtgttgatgggtctagggaaaggatggccgttgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcagctggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacaccaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaattcaggaagtggatagaaccttagcaaaagaaggcatcaaaagaggagaaacggaccatcacgctgtgtcacgaggctcagcaaaactgagatggttcgttgagagaaatatggtcacaccagaagggaaagtagtggacctcggttgtggcagaggaggttggtcatactattgtggaggactaaaaaacgtaagagaagtgaaaggcctaacaaaaggaggaccaggacatgaagaacccatccccatgtcaacatatgggtggaacctagtgcgtcttcaaagtggagttgacgttttcttcatcccgccagaaaagtgtgacacattgttgtgtgacataggggagtcatcaccaaaccccacagtggaagcaggacgaacactcagagtccttaatttagtagaaaattggttgaacaacaacactcaattttgcataaaggttctcaacccatatatgccctcagttatagaaaaaatggaaacactgcaaaggaaatatggaggagccttagtgagaaatccactctcacggaactccacacatgagatgtactgggtatccaacgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaacttagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtccttcccatggtgacacagatggcaatgacagacacgactccatttggacaacagcgtgtctttaaagaaaaagtggacacgagaacccaagaaccgaaagaaggcacgaagaaactaatgaaaatcacggcagagtggctgtggaaagaattagggaagaaaaagacacctaggatgtgcaccagagaagaatttacaagaaaggtgagaagcaatgcagccttgggggccgtattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtaccaaaacaaggtggtgcgtgtgcaaagaccaacaccaagaggcacagtaatggacattatatcgagaagagaccaaagaggtagtgggcaagttggcacctatggactcaatactttcaccaacatggaagcccaattaatcagacagatggagggagaaggagtctttaaaaacattcagcacctgacagtcacagaagaaatcgctgtgcaaaactggttagcaagggtggggcgcgaaaggttatcaagaatggccatcagtggagatgattgtgttgtgaaacctttagatgacaggtttgcaagcgctttgacagctctgaatgacatgggaaagattagaaaagacatacaacaatgggaaccttcaagaggatggagcgattggacacaagtccccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcggtgccatcacattgggttccaacaagtcgaacaacctggtccatacacgccaaacatgaatggatgacaacggaagacatgctgacagtctggaacagagtgtggattcaagaaaacccatggatggaagacaaaaccccagtggaatcatgggaggaaatcccatacttgggaaaaagagaagaccaatggtgcggctcactgattgggttaacaagcagggccacatgggcaaagaacatccaagcagcaataaatcaagttagatctctcataggcaatgaggaatacacagattatatgccatccatgaaaagattcagaagagaagaggaagaagcaggagtcctgtggtag

SEQ ID NO: 675 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcaaggacgaggaccattaaaattgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaagataccttccggccatagtcagagaagctataaaacggggtttgagaacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggaggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgtgacacattgttgtgtgacataggggagtcatcaccaaatcccacagtggaagcaggacgaacactcagagtccttaatttagtagaaaattggctgaacaacaacactcaattctgcataaaagttctcaacccatatatgccctcagttatagaaaaaatggaagcactgcaaaggaaatatggaggagccttagtgagaaatccactctcacggaactccacacatgagatgtactgggtatccaatgcttccgggaacatagtgtcatcagtgaacatgatttcaagaatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccttaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtttacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 676 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcaaggacgaggaccattaaaattgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttccatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactagcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaaaataccttccggccatagtcagagaagctataaaacggggtttgagaacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtagagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgaggggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggcggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgtgacacattgttgtgtgacataggggagtcatcaccaaatcccacagtggaagcaggacgaacactcagagtccttaatttagtagaaaattggctgaacaacaacactcaattctgcataaaagttctcaacccatatatgccctcagttatagaaaaaatggaagcactgcaaaggaaatatggaggagccttagtgagaaatccactctcacggaactccacacatgagatgtactgggtatccaatgcttccgggaacatagtgtcatcagtgaacatgatttcaagaatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccttaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggtagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 677 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcaaggacgaggaccattaaaattgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgaggggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagaatctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagaaaagactgaccatcatggacctccacccaggggcaggaaagacgaaaagataccttccggccatagtcagagaagctataaaacggggtttgaggacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaattcagaacaaccaaatcctggaagaaaatgtggaagtggaaatctggacaaaagaaggggaaaggaagaaattgaaacccaggtggctggacgctaggatctattctgacccactggcgctaaaagaattcaaagaatttgcagctggaagaaagtctctgaccctgaacctaatcacagaaatgggtaggcttccaactttcatgactcagaaggcaagagacgcattggacaacttagcagttctgcacacggctgaagcaggtggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggactccaagcaaaagcaaccagagaagctcagaaaagagcagcggcgggtattatgaaaaacccaaccgtcgatggaataacagtgatcgatctagatccaataccttatgatccaaagtttgaaaagcagttgggacaagtaatgctcctagtcctctgtgtgactcaagtattgatgatgaggactacatgggctctgtgtgaggctttaaccttagcgacagggcccatctccacattgtgggaaggaaatccagggaggttttggaacactaccattgcagtgtcaatggctaatatttttagagggagttacttggctggagctggacttctcttttccatcatgaagaacacaaccaacacaagaaggggaactggcaacataggagagacgcttggagagaaatggaaaagccgactgaacgcactggggaaaagtgaattccagatctacaagaaaagtggaatccaggaagtggatagaacattagcaaaagaaggcatcaaaagaggagaaacggaccatcacgctgtgtcgcgaggctcagcaaaactgagatggttcgttgagagaaacatgatcacaccagaagggaaagtagtggacctcggttgtggcagaggaggctggtcatactattgtgggggactaaagaatgtaagagaagtgaaaggcctgacaaagggaggaccaggacacgaagaacccatccccatgtctacatatgggtggaacctagtgcgtcttcaaagtggagttgacgttttcttcactccgccagaaaagtgcgacacattgctgtgtgacataggggagtcgtcaccaaatcccacggtagaagcaggacggacactcagagtcctcaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgaaacacaagaaagccacctacgagccagatgttgacctaggaagcggaacccgcaacattggaattgaaagtgaggtaccaaacctggacataattgggaaaagaatagaaaaaataaaacaagagcatgaaacatcatggcactatgaccaagatcacccatacaaaacatgggcttaccatggtagctacgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagagaagaagctaggggagttcggcaaggcaaaaggcagcagagccatatggtatatgtggcttggagcacgttttttagagtttgaagccctaggattcttgaatgaagatcactggttctccagagagaactccctgagtggagtggaaggagaagggctgcacaagctaggctacatcctaagagacgtgagcaagaaagagggaggagcaatgtatgccgatgacaccgcaggatgggacacaagaatcacactggaagatctaaaaaatgaagaaatggtaacaaaccacatggaaggagaacacaagaaactagctgaggctattttcaaattaacgtaccaaaacaaggtggtgcgtgtgcaaagaccaacaccaagaggcacagtaatggatatcatatcaagaagagaccaaagaggtagcgggcaagttggtacctatggactcaacactttcactaatatggaagcccaactaatcagacagatggaaggagaaggagtctttaaaaacattcagcacctgacagccacagaagaaattgccgtgcaaaactggttagcaagagtggggcgcgaaaggttatcaagaatggccatcagtggagatgactgtgtagtgaaacctttagatgacaggttcgcaagtgctttgacagctctaaatgacatgggaaaggtcaggaaggacatacaacaatgggaaccttcaagagggtggaatgattggacacaggtgcccttctgttcacaccatttccatgagttaatcatgaaagacggtcgtgtacttgtagttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 678 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcaaggacgaggaccattaaaattgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgaggggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacgctgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccaaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattggcagtgactatcatggctatcttgtgcgtcccaaatgcagtgatattacaaaatgcatggaaagtgagttgcacaatactggcagtggtgtccgtttccccactgatattgacatcctcacagcagaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgacattcccatgacaggaccactagtggctggagggctcctcactgtgtgctacgtgctcactggacgatcggccgacttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtcctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagattgaagatgacattttccgaaagagaagactgaccatcatggacctccacccaggggcgggaaagacgaaaagataccttccggccatagtcagagaagccataaaacggggtttgaggacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggaaatgggtgaggcagctgggattttcatgacagccactcccccgggaagtagagatccatttcctcagagcaatgcaccaatcatggatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacacctgaaggaatcattcccagtatgtttgaaccagagcgtgaaaaagtggatgccattgatggtgaataccgcttgagaggagaagcacggaaaacctttgtggacttaatgagaagaggagacctaccagtctggttggcctacaaagtggcagctgaaggcatcaactatgcagacagaaggtggtgttttgatggaatcaggaacaaccaaatcctggaagaaaatgtggaagtggaaatctggacaaaagaaggggaaaggaagaaattgaaacccaggtggctggacgctaggatctattctgacccactggcgctaaaagaattcaaagaatttgcagctggaagaaagtctctgaccctgaacctaatcacagaaatgggtaggcttccaactttcatgactcagaaggcaagagacgcattggacaacttagcagttctgcacacggctgaagcaggtggaagggcgtacaatcatgccctcagtgaactgccggagaccctagagacactgcttttactgacacttctggctacagtcacaggaggaatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggactccaagcaaaagcaaccagagaagctcagaaaagagcagcggcgggtattatgaaaaacccaaccgtcgatggaataacagtaatcgatctagatccaataccttatgatccaaagtttgaaaagcagttgggacaagtaatgctcctagtcctctgtgtgactcaagtattgatgatgaggactacatgggctctgtgtgaggctttaaccttagcgacagggcccatctccacattgtgggaaggaaatccagggaggttttggaacactaccattgcagtgtcaatggctaatatttttagagggagttacttggctggagctggacttctcttttccatcatgaagaacacaaccaacacaagaaggggaactggcaacataggagagacgcttggagagaaatggaaaagccgactgaacgcactggggaaaagtgaattccagatctacaagaaaagtggaatccaggaagtggatagaacattagcaaaagaaggcatcaaaagaggagaaacggaccatcacgctgtgtcgcgaggctcagcaaaactgagatggttcgttgagagaaacatgatcacaccagaagggaaagtagtggacctcggttgtggcagaggaggctggtcatactattgtgggggactaaagaatgtaagagaagtgaaaggcctgacaaagggaggaccaggacacgaagaacccatccccatgtctacatatgggtggaacctagtgcgtcttcaaagtggagttgacgttttcttcactccgccagaaaagtgcgacacattgctgtgtgacataggggagtcgtcaccaaatcccacggtagaagcaggacggacactcagagtcctcaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgaaacacaagaaagccacctacgagccagatgttgacctaggaagcggaacccgcaacattggaattgaaagtgaggtaccaaacctggacataattgggaaaagaatagaaaaaataaaacaagagcatgaaacatcatggcactatgaccaagatcacccatacaaaacatgggcttaccatggtagctacgaaacaaaacaaactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagagaagaagctaggggagttcggcaaggcaaaaggcagcagagccatatggtatatgtggcttggagcacgttttttagagtttgaagccctaggattcttgaatgaagatcactggttctccagagagaactccctgagtggagtggaaggagaagggctgcacaagctaggctacatcctaagagacgtgagcaagaaagagggaggagcaatgtatgccgatgacaccgcaggatgggacacaagaatcacactggaagatctaaaaaatgaagaaatggtaacaaaccacatggaaggagaacacaagaaactagctgaggctattttcaaattaacgtaccaaaacaaggtggtgcgtgtgcaaagaccaacaccaagaggcacagtaatggatatcatatcaagaagagaccaaagaggtagcgggcaagttggtacctatggactcaacactttcactaatatggaagcccaactaatcagacagatggaaggagaaggagtctttaaaaacattcagcacctgacagccacagaagaaattgccgtgcaaaactggttagcaagagtggggcgcgaaaggttatcaagaatggccatcagtggagatgactgtgtagtgaaacctttagatgacaggttcgcaagtgctttgacagctctaaatgacatgggaaaggtcaggaaggacatacaacaatgggaaccttcaagagggtggaatgattggacacaggtgcccttctgttcacaccatttccatgagttaatcatgaaagacggtcgtgtacttgtagttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 679 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcaaggacgaggaccattaaaattgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtataatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaaactttctcattgatggccccgaaacggcagaatgccccaacacaaatagagcttggaactcgttggaggtcgaagactacggctttggagtgttcaccaccaacgtatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctctcaaagcactataccagagaccattcttgaattgactgatgcgttagccttaggcatgatggtcctcaaaatagtaagaaacatggaaaagtatcaattagcagtgactatcatggctatcttgtgcgtccctaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaacgacaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaaagatgaccatcatggacctccacccaggggcgggaaagacgaaaagataccttccggccatagtcagagaagctataaaacggggtttgaggacattaatcttggcccccaccagagtcgtggcagctgaaatggaggaagctctaaggggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggtgaataccgcttgagaggagaagcaaggaaaacctttgtggacttaatgagaagaggagacctaccagtctggttggcctacaaagtggcagctgaaggcatcaactatgcagacagaaggtggtgttttgatggaatcaggaacaaccaaatcctggaagaaaatgtggaagtggaaatctggacaaaagaaggggaaaggaagaaattgaaacccagatggctggacgctaggatctattctgacccactggcgctaaaagaattcaaagaatttgcagctggaagaaagtctctgaccctgaacctaatcacagaaatgggtaggcttccaactttcatgactcagaaggcaagagacgcattggacaacttagcagttctgcacacggctgaagcaggtggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggactccaagcaaaagcaaccagagaagctcagaaaagagcagcggcgggtattatgaaaaacccatccgtcgatggaataacagtgatcgatctagatccaataccttatgatccaaagtttgaaaagcagttgggacaagtaatgctcctagtcctctgtgtgactcaagtattgatgatgaggactacatgggctctgtgtgaggctttaaccttagcgacagggcccatctccacattgtgggaaggaaatccagggaggttttggaacactaccattgcagtgtcaatggctaatatttttagagggagttacttggctggagctggacttctcttttccatcatgaagaacacaaccaacacaagaaggggaactggcaacataggagagacgcttggagagaaatggaaaagccgactgaacgcactggggaaaagtgaattccagatctacaagaaaagtggaatccaggaagtggatagaacattagcaaaagaaggcatcaaaagaggagaaacggaccatcacactgtgtcgcgaggctcagcaaaactgagatggttcgttgagagaaacatgatcacaccagaagggaaagtactggacctcggttgtggcagaggaggctggtcatactattgtgggggactaaagaatgtaagagaagtgaaaggcctgacaaagggaggaccaggacacgaagaacccatccccatgtctacatatgggtggaacctagtgcgtcttcaaagtggagttgacgttttcttcactccgccagaaaagtgcgacacattgctgtgtgacataggggagtcgtcaccaaatcccacggtagaagcaggacggacactcagagtcctcaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgaaacacaagaaagccacctacgagccagatgttgacctaggaagcggaacccgcaacattggaattgaaagtgaggtaccaaacctggacataattgggaaaagaatagaaaaaataaaacaagagcatgaaacatcatggcactatgaccaagatcacccatacaaaacgtgggcataccatggtagctacgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagagaagaagctaggggagttcggcaaggcaaaaggcagcagagccatatggtatatgtggcttggagcacgttttttagagtttgaagccctaggattcttgaatgaagatcactggttctccagagagaactccctgagtggagtggaaggagaagggctgcacaagctaggctacatcctaagagacgtgagcaagaaagagggaggagcaatgtatgccgatgacaccgcaggatgggacacaagaatcacactggaagatctaaaaaatgaagaaatggtaacaaaccacatggaaggagaacacaagaaactagctgaggctattttcaaattaacgtaccaaaacaaggtggtgcgtgtgcaaagaccaacaccaagaggcacagtaatggatatcatatcaagaagagaccaaagaggtagcgggcaagttggtacctatggactcaacactttcactaatatggaagcccaactaatcagacagatggaaggagaaggagtctttaaaaacattcagcacctgacagccacagaagaaattgccgtgcaaaactggttagcaagagtggggcgcgaaaggttatcaagaatggccatcagtggagatgactgtgtagtgaaacctttagatgacaggttcgcaagtgctttgacagctctaaatgacatgggaaaggtcaggaaggacatacaacaatgggaaccttcaagagggtggaatgattggacacaggtgcccttctgttcacaccatttccatgagttaatcatgaaagacggtcgtgtacttgtagttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 680 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcaaggacgaggaccattaaaattgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtccctaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaagcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaagataccttccggccatagtcagagaagctataaaacggggtttgagaacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggaggaagggcgtacaatcatgccctcagtgaattgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggtgttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttgtggcagaggaggctggtcttactattgtggaggactaaagaatgtaagagaagtgaaaggcctaacaaaaggaggaccaggacacgaagaacccatccccatgtctacatatgggtggaacctagtgcgtcttcaaagtggagttgacgttttcttcactccgccagaaaagtgcgacacattgctgtgtgacataggggagtcgtcaccaaatcccacggtagaagcaggacggacactcagagtcctcaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgaaacacaagaaagccacctacgagccagatgttgacctaggaagcggaacccgcaacattggaattgaaagtgaggtaccaaacctggacataattgggaaaagaatagaaaaaataaaacaagagcatgaaacatcatggcactatgaccaagatcacccatacaaaacgtgggcataccatggtagctacgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagcacgcttcctggagtttgaagccttaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtaccaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactgcttagcaagattggggcgcgaaaggttatcaagaatggccatcagtggagatgattgtgtagtgaaacctttagatgacaggttcgcaagtgctttgacagctctaaatgacatgggaaagattaggaaggacatacaacaatgggaaccttcaagaggatggaatgattggacacaggtgcccttctgttcacaccatttccatgagttaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 681 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcaaggacgaggaccattaaaattgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccttaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacgctgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagaatctcataaccaaacctttctcattgatggccccaagacggcagaatgccccaacacaaatagagcttggaactcgttggaggtcgaagactacggctttggagtgttcaccaccaatatatggctaaaattgaaagaaaaacaggatgcattgtgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaaaaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaagataccttccggccatagtcagagaagctataaaacggggtttgagaacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaatacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggcggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggtgttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgtgacacattgttgtgtgacataggggagtcatcaccaaatcccacagtggaagcaggacgaacactcagagtccttaatttagtagaaaattggctgaacaacaacactcaattctgcataaaagttctcaacccatatatgccctcagttatagaaaaaatggaagcactgcaaaggaaatatggaggagccttagtgagaaatccactctcacggaactccacacatgagatgtactgggtatccaatgcttccgggaacatagtgtcatcagtgaacatgatttcaagaatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccttaggattcctaaatgaagatcactggttctccagagagaactccctgagtggagtggaaggagaagggctgcacaagctacgttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtttttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 682 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcaaggacgaggaccattaaaattgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagattgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagttttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcatgcaggaaaacgatctctgcggcctcagcccactgagctaaagtattcatggaaaacatggggcaaagcaaaaatgctctccacagagtctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaagataccttccggccatagtcagagaagctataaaacggggtttgagaacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactttagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggcggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggtgttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactgggaaaaagtgaatcacagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttgtggcagaggaggctggtcatactattgtggaggaataaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgtgacacattgttgtgtgacataggggagtcatcaccaaatcccacagtggaagcaggacgaacactcagagtccttaatttagtagaaaattggctgaacaacaacactcaattctgcataaaagttctcaacccatatatgccctcagttatagaaaaaatggaagcactgcaaaggaaatatggaggagccttagtgagaaatccactctcacggaactccacacatgagatgtactgggtatccaatgcttccgggaacatagtgtcatcagtgaacatgatttcaagaatgttgatcaacagattcacaatgagacacaagaaagccacttatgagccggatgttgacctcggaagcggaacccgtaacattggaattgaaagtgaaataccaaacctagacataattgggaaaagaatagaaaaaataaagcaagagcatgaaacatcatggcattacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccttaggattcctaaatgaagatcactggttctccagagagaactccctgagtggattggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 683 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcaaggacgaggaccattaaaattgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaagaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaaaataccttccggccatagtcagagaagctataaaacggggtttgagaacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtgatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactttagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgaggggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggcggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatatttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtggtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgcgacacattgctgtgtgacataggggagtcgtcaccaaatcccacggtagaggcaggacggacactcagagtcctcaacttagtggaaaattggttgaacaacaacacccaattttgcataaaggttctcaacccatacatgccctcagtcatagaaaaaatggaagcactacaaaggagatatggaggagccttagtgaggaatccactctcacgaaactccacacatgagatgtactgggtatccaatgcctccgggaacatagtgtcatcagtgaacatgatttcaaggatgttgatcaacagattcacaatgaaacacaagaaagccacctacgagccagatgttgacttaggaagcggaacccgcaacattggaattgaaagtgaggtaccaaacctggacataattgggaaaagaatagaaaaaataaaacaagagcatgaaacatcatggcactatgaccaagatcacccatacaaaacatgggcttaccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccttaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 684 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcaaggacgaggaccattaaaattgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcgaaaatgctctccacagaatctcataaccagacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattgccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtccctaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaagataccttccggccatagtcagagaagctataaaacggggtttgagaactttaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactttagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggaggaagggcgtacaatcatgccctcagtgaattgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggtgttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactggggaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgtgacacattgctgtgtgacataggggagtcatcaccaaatcccacggtggaggcaggacggacactcagagtcctcaacttagtggaaaattggttgaacaacaacacccaattctgcataaaggttctcaacccatacatgccctcagtcatagaaaaaatggaagcactacaaaggagatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccacttacgagccggatgttgacctcggaagcggaacccgcaacattggaattgaaagtgaggtaccaaacctggacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccttaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 685 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcaaggacgaggaccattaaaattgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcttcataggagtcattatcacatggataggaatgaactcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccagtaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaaaataccttccggccatagtcagagaagctataaaacggggtttgagaacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactttagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgaggggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggcggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggtgttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttgtggcagaggaggctggtcatactattgtggaggactaaaaaacgtaagagaagtgaaaggcctaacaaaaggaggaccaggacacgaagaacccatccccatgtctacatatgggtggaacctagtgcgtcttcaaagtggagttgacgttttcttcactccgccagaaaagtgcgacacattgctgtgtgacataggggagtcgtcaccaaatcccacggtagaggcaggacggacactcagagtcctcaacttagtggaaaattggttgaacaacaacacccaattttgcataaaggttctcaacccatacatgccctcagtcatagaaaaaatggaagcactacaaaggagatatggaggagccttagtgaggaatccactctcacgaaactccacacatgagatgtactgggtatccaatgcctccgggaacatagtgtcatcagtgaacatgatttcaaggatgttgatcaacagattcacaatgaaacacaagaaagccacctacgagccagatgttgacttaggaagcggaacccgcaacattggaattgaaagtgaggtaccaaacctggacataattgggaaaagaatagaaaaaataaaacaagagcatgaaacatcatggcactatgaccaagatcacccatacaaaacgtgggcttaccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaaaccttaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctggcagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 686 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcaaggacgaggaccattaaaattgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctatcagaaaatgaggtgaagttaactatcatgacaggagacatcaaaggaatcatgcatgcaggaaaacgatctctgcggcctcagcccactgagctaaagtattcatggaaaacatggggcatagcaaaaatgctctccacagagtctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttacggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaagataccttccggccatagtcagagaagctataaaacggggtttgagaacattaatcttggcccccaccagagtcgtggcagctgaaatggaggaagctctgagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattttggcaggacccatgccagtgacccactttagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggcggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggtgttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactgggaaaaagtgaattccagatatacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttctggcagaggaggctggtcatactattgtggaggactaaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgtgacacattgttgtgtgacataggggagtcatcaccaaatcccacagtggaagcaggacgaacactcagagtccttaatttagtagaaaattggctgaacaacaacactcaattctgcataaaagttctcaacccatatatgccctcagttatagaaaaaatggaagcactgcaaaggaaatatggaggagccttagtgagaaatccactctcacggaactccacacatgagatgtactgggtatccaatgcttccgggaacatagtgtcatcagtgaacatgatttcaagaatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccttaggattcctaaatgaagatcactggttctccagagagaactccctgagtggagtggaaggagaagggtcgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 687 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcaaggacgaggaccattaaaattgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaacgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcatgcaggaaaacgatctctgcggcctcagcccactgagctaaagtattcatggaaaacatggggcaaagcaaaaatgctctccacagagtctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaagataccttccggccatagtcagagaagctataaaacggggtttgagaacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactttagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggaggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggtgttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggaaagacgcttggagagaaatggaaaagccgactgaacgcactgggaaaaattgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgtgacacattgttgtgtgacataggggagtcatcaccaaatcccacagtggaagcaggacgaacactcagagtccttaatttagtagaaaattggctgaacaacaacactcaattctgcataaaagttctcaacccatatatgccctcagttatagaaaaaatggaagcactgcaaaggaaatatggaggagccttagtgagaaatccactctcacggaactccacacatgagatgtactgggtatccaatgcttccgggaacatagtgtcatcagtgaacatgatttcaagaatgttgatcaacagattcacaatgagacacaagaaagccacttacgagccggatgttgacctcggaagcgggacccgtaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccttaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 688 - DNA, 10176 bp, Dengue virus
atgaataaccaacggaaaaaggcgagaaacacgcctttcaatatgctgaaacgcgagagaaaccgcgtgtcaactgtacaacagttgacaaagagattctcacttggaatgctgcagggacgaggaccactaaaattgttcatggccctggtggcattccttcgtttcctaacaatcccaccaacagcagggatattaaaaagatggggaacaattaaaaaatcaaaggctattaatgttctgagaggcttcaggaaagagattggaaggatgctgaatatcttaaacaggagacgtagaactgtaggcatgatcatcatgctgactccaacagtgatggcgtttcatctgaccacacgcaacggagaaccacacatgattgtcagtagacaagaaaaagggaaaagccttctgttcaagacaaaggatggcacgaacatgtgtaccctcatggccatggaccttggtgagttgtgtgaagacacaatcacgtataaatgtccttttctcaagcagaacgaaccagaagacatagattgttggtgcaactccacgtccacatgggtaacttatgggacatgtaccaccacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggctttaccataatggccgcaatcctggcatacaccatagggacgacgcatttccaaagagtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaacaaaccaacactggactttgaactgataaaaacagaagccaaacaacctgccaccttaaggaagtactgtatagaggccaaactgaccaacacgacaacagactcgcgctgcccaacacaaggggaacccaccctgaatgaagagcaggacaaaaggtttgtctgcaaacattccatggtagacagaggatggggaaatggatgtggattgtttggaaaaggaggcatcgtgacctgtgctatgttcacatgcaaaaagaacatggaaggaaaaattgtgcagccagaaaacctggaatacactgtcgtgataacacctcattcaggggaagaacatgcagtgggaaatgacacaggaaaacatggtaaagaagtcaagataacaccacagagctccatcacagaggcggaactgacaggctatggcactgttacgatggagtgctctccaagaacgggcctcgacttcaatgagatggtgttgctgcaaatggaagacaaagcctggctggtgcacagacaatggttcctagacctaccgttgccatggctgcccggagcagacacacaaggatcaaattggatacagaaagaaacactggtcaccttcaaaaatccccatgcgaaaaaacaggatgttgttgtcttaggatcccaagagggggccatgcatacagcactcacaggggctacggaaatccagatgtcatcaggaaacctgctgttcacaggacatctcaagtgcaggctgagaatggacaaattacaacttaaagggatgtcatactccatgtgcacaggaaagtttaaaattgtgaaggaaatagcagaaacacaacatggaacaatagtcattagagtacaatatgaaggagacggctctccatgcaagatcccctttgagataatggatctggaaaaaagacatgttttgggccgcctgatcacagtcaacccaattgtaacagaaaaggacagtccagtcaacatagaagcagaacctccattcggagacagctacatcatcataggagtggaaccaggacaattgaagctggactggttcaagaaaggaagttccatcggccaaatgtttgagacaacaatgaggggagcgaaaagaatggccattttgggtgacacagcctgggattttggatctctgggaggagtgttcacatcaataggaaaggctctccaccaggtttttggagcaatctacggggctgctttcagtggggtctcatggactatgaagatcctcataggagttatcatcacatggataggaatgaactcacgtagcacatcactgtctgtgtcactggtgttagtgggaatcgtgacactgtacttgggagttatggtgcaggccgatagtggttgcgttgtgagctggaagaacaaagaactaaaatgtggcagtggaatattcgtcacagataacgtgcatacatggacagaacaatacaagttccaaccagaatccccttcaaaactggcctcagccatccagaaagcgcatgaagagggcatctgtggaatccgctcagtaacaagactggaaaatcttatgtggaaacagataacatcagaattgaatcatattctatcagaaaatgaagtgaaactgaccatcatgacaggagacatcaaaggaatcatgcaggtaggaaaacgatctttgcggcctcaacccactgagttgaggtattcatggaaaacatggggtaaagcgaaaatgctctccacagaactccacaatcagaccttcctcattgatggtcccgaaacagcagaatgccccaacacaaacagagcttggaattcactggaagttgaggactacggctttggagtattcactaccaatatatggctaagattgagagaaaagcaggatgtattttgtgactcaaaactcatgtcagcggccataaaggacaacagagccgtccatgctgatatgggttattggatagaaagcgcactcaatgatacatggaagatagagaaagcttctttcattgaagtcaaaagttgccactggccaaagtcacacaccctatggagtaatggagtgctagaaagcgagatggtcattccaaagaatttcgctggaccagtgtcacaacataataacagaccaggctattacacacaaacagcaggaccttggcatctaggcaagcttgagatggactttgatttctgcgaagggactacagtggtggtaaccgagaactgtggaaacagagggccctctttaagaacaaccactgcctcaggaaaactcataacggaatggtgttgtcgatcttgcacactaccaccactaagatacagaggtgaggatggatgttggtacgggatggaaatcagaccattgaaagagaaagaagaaaatctggtcagttctctggttacagccggacatgggcagattgacaatttctcattaggaatcttgggaatggcactgttccttgaagaaatgctcaggactcgagtaggaacaaaacatgcaatattactagtcgcagtttctttcgtgacgctaatcacagggaacatgtcttttagagacctgggaagagtgatggttatggtgggtgccaccatgacagatgacataggcatgggtgtgacttatctcgctctactagcagcttttagagtcagaccaacctttgcagctggactgctcttgagaaaactgacctccaaggaattaatgatgactaccataggaatcgttcttctctcccagagtagcataccagagaccattcttgaactgaccgacgcgttagctctaggcatgatggtcctcaagatggtgagaaacatggaaaaatatcagctggcagtgaccatcatggctattttgtgcgtcccaaatgctgtgatattacagaacgcatggaaagtgagttgcacaatattggcagtggtgtctgtttcccccctgctcttaacatcctcacaacagaaagcggactggataccattagcgttgacgatcaaaggtcttaatccaacagccatttttctaacaaccctctcaagaaccaacaagaaaaggagctggcctttaaatgaggccatcatggcggttgggatggtgagtatcttggccagctctctcttaaagaatgacatccccatgacaggaccattagtggctggagggctccttactgtgtgctacgtgctaactgggcggtcagccgatctggaattagagagagctaccgatgtcaaatgggatgaccaggcagagatatcaggtagcagtccaatcctgtcaataacaatatcagaagatggcagcatgtcaataaagaatgaagaggaagagcaaacactgactatactcattagaacaggattgcttgtgatctcaggactctttccggtatcaataccaattacagcagcagcatggtacctgtgggaagtaaagaaacaacgggctggagtgctgtgggatgtcccctcaccaccacccgtgggaaaagctgaattggaagatggagcctacagaatcaagcaaaaaggaatccttggatattcccagatcggagctggagtttacaaagaaggaacatttcacacaatgtggcacgtcacacgtggcgctgtcctaatgcataaggggaagaggattgaaccatcatgggcggacgtcaagaaagacttaatatcatatggaggaggttggaagctagaaggagaatggaaagaaggagaagaagtccaggtcttggcattggagccagggaaaaatccaagagccgtccaaacaaagcctggcctttttagaaccaacactggaaccataggtgccgtatctctggacttttcccctgggacgtcaggatctccaatcgtcgacaaaaaaggaaaagttgtaggtctctatggcaatggtgtcgttacaaggagtggagcatatgtgagtgccatagctcagactgaaaaaagcattgaagacaatccagagattgaagatgacatctttcgaaagagaagattgactatcatggatctccacccaggagcaggaaagacaaagagatacctcccggccatagtcagagaggccataaaaagaggcttgagaacactaatcctagcccccactagagtcgtggcagctgaaatggaggaagcccttagaggacttccaataagataccaaactccagctatcagggctgagcacaccgggcgggagattgtagacttaatgtgtcatgccacatttaccatgaggctgctatcaccaatcagggtgccaaattacaacctgatcatcatggacgaagcccattttacagatccagcaagcatagcagctaggggatacatctcaactcgagtggagatgggggaggcagctggaatttttatgacagccactcctccgggtagtagagatccatttcctcagagcaatgcaccaattatggacgaagaaagagaaattccggaacgttcatggaactctgggcacgagtgggtcacggattttaaaggaaagactgtctggtttgttccaagcataaaaaccggaaatgacatagcagcctgcctgagaaagaatggaaagagggtgatacaactcagtaggaagacctttgattctgaatatgtcaagactagaaccaatgactgggatttcgtggttacaactgacatctcggaaatgggcgccaactttaaagctgagagggtcatagaccccagacgctgcatgaaaccagttatattgacagacggcgaagagcgggtgattctggcaggacccatgccagtgacccactctagtgcagcacaaagaagagggagaataggaaggaatccaaggaatgaaaatgatcaatatatatatatgggggaaccactggaaaatgatgaagactgtgcgcactggaaggaagctaagatgctcctagataatatcaacacacctgaaggaatcattcccagcttgttcgagccagagcgtgaaaaggtggatgccattgacggtgaatatcgcttgagaggagaagcacggaaaacttttgtggacctaatgagaagaggagacctaccagtctggttggcttataaagtggcagctgaaggtatcaactacgcagacagaagatggtgttttgacggaaccagaaacaatcaaatcttggaagaaaatgtggaagtggaaatctggacaaaggaaggggaaaggaaaaaattgaaacctagatggttagatgctaggatctactccgacccactggcgctaaaagagttcaaggaatttgcagccggaagaaagtccctaaccctgaacctaattacagagatgggcagactcccaacttttatgactcagaaggccagagatgcactagacaacttggcggtgctgcacacggctgaagcgggtggaaaggcatacaatcatgctctcagtgaattaccggagaccctggagacattgcttttgctgacactgttggccacagtcacgggaggaatcttcctattcctgatgagcggaaggggtatggggaagatgaccctgggaatgtgctgcataatcacggccagcatcctcttatggtatgcacaaatacagccacattggatagcagcctcaataatattggagttctttctcatagtcttgctcattccagaaccagaaaagcagaggacacctcaggataatcaattgacttatgtcatcatagccatcctcacagtggtggccgcaaccatggcaaacgaaatgggttttctggaaaaaacaaagaaagacctcggactgggaaacattgcaactcagcaacctgagagcaacattctggacatagatctacgtcctgcatcagcatggacgttgtatgccgtggctacaacatttatcacaccaatgttgagacatagcattgaaaattcctcagtaaatgtgtccctaacagccatagctaaccaagccacagtgctaatgggtctcggaaaaggatggccattgtcaaagatggacattggagttcccctccttgctattgggtgttactcacaagtcaaccctataaccctcacagcggctcttcttttattggtagcacattatgccatcataggaccgggacttcaagccaaagcaactagagaagctcagaaaagagcagcagcgggcatcatgaaaaacccaactgtggatggaataacagtgatagatctagatccaataccctatgatccaaagtttgaaaagcagttgggacaagtaatgctcctagtcctctgcgtgacccaagtgctgatgatgaggactacgtgggctttgtgtgaagccttaactctagcaactggacccgtgtccacattgtgggaaggaaatccagggagattctggaacacaaccattgcagtgtcaatggcaaacatctttagagggagttacctggctggagctggacttctcttttctatcatgaagaacacaaccagcacgagaagaggaactggcaatataggagaaacgttaggagagaaatggaaaagcagactgaacgcattggggaaaagtgaattccagatctacaaaaaaagtggaattcaagaagtggacagaaccttagcaaaagaaggcattaaaagaggagaaacggatcatcacgctgtgtcgcgaggctcagcaaaactgagatggttcgttgaaaggaatttggtcacaccagaagggaaagtagtggaccttggttgtggcagagggggctggtcatactattgtggaggattaaagaatgtaagagaagttaaaggcttaacaaaaggaggaccaggacacgaagaacctatccctatgtcaacatatgggtggaatctagtacgcttacagagcggagttgatgttttttttgttccaccagagaagtgtgacacattgttgtgtgacataggggaatcatcaccaaatcccacggtagaagcgggacgaacactcagagtcctcaacctagtggaaaattggctgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgatcaacagattcactatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgatcaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactccttttggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgtaccagagaagaattcacaaaaaaggtgagaagcaatgcagccttgggggccatattcaccgatgagaacaagtggaaatcggcgcgtgaagccgttgaagatagtaggttttgggagctggttgacaaggaaaggaacctccatcttgaagggaaatgtgaaacatgtgtatacaacatgatggggaaaagagagaaaaaactaggagagtttggtaaagcaaaaggcagcagagccatatggtacatgtggctcggagcacgcttcttagagtttgaagccctaggatttttgaatgaagaccattggttctccagagagaactccctgagtggagtggaaggagaagggctgcataagctaggttacatcttaagagaggtgagcaagaaagaaggaggagcaatgtatgccgatgacaccgcaggctgggacacaagaatcacaatagaggatttgaaaaatgaagaaatgataacgaaccacatggcaggagaacacaagaaacttgccgaggccatttttaaattgacgtaccaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagtaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacgcaggtgcccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccatcacactggattccaacaagccggacaacctggtccatacacgccagccatgaatggatgacgacggaagacatgttgacagtttggaacagagtgtggatcctagaaaatccatggatggaagacaaaactccagtggaatcatgggaggaaatcccatacctgggaaaaagagaagaccaatggtgcggctcgctgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtggtag

SEQ ID NO: 689 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgtttaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaagggccttgattttcatcttactgacagccgtcgctccttcaatgacaatgcgttgcataggaatatcaaatagagacttcgtagaaggggtatcaggaggaagctgggttgacatagtcttagaacatggaagttgtgtgacgacgatggcaaaaaataaaccaacattggattttgaactgataaaaacagaagccaaacaacctgccaccctaaggaagtactgtatagaagcaaagctgaccaacacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcgaggaaatcaaaataacaccacagagttccatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgcaagatcccttttgagataatggatttggaaaaaagacacgccttaggtcgcctgattacagttaacccaatcgtaacagaaaaagatagcccagtcaacatagaagcagaacctccattcggagacagctacatcatcataggagtagagccgggacaactgaagctcaattggtttaagaagggaagttccatcggccaaatgtttgagacaacaatgcgaggagcaaagagaatggccatattaggtgacacagcctgggattttggatccctgggaggagtgtttacatctataggaaaggctctccaccaagttttcggagcaatctatggggctgtttttagtggggtctcatggactatgaaaatcctcataggagtcatcatcacatggataggaatgaattcacgtagtacctcactgtctgtgtcactagtattggtgggagtcgtgacactgtacctgggagctatggtgcaggctgatagtggttgcgtcgtgagctggaaaaacaaagaattgaaatgtggcagcgggatcttcattacagataacgtgcacacgtggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacatcctatcagaaaatgaggtaaagttgaccattatgacaggagacattaaaggaatcatgcaggcaggaaaacgatctttgcggccccagcccactgaactgaagtactcatggaaaacatggggaaaggcgaaaatgctctccacagagtctcacaaccagacctttcttattgatggccctgaaacagcagaatgccccaacacaaacagagcttggaactcgttggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatagagaaagcctctttcattgaagttaaaagctgccactggccaaagtcacacaccctctggagcaatggagtattggaaagtgagatgataattccaaaaaattttgccgggccagtgtcacaacacaactacagaccaggctactatacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggatggatgctggtacgggatggaaatcagaccattgaaagagaaagaggagaatttggtcaactccttggtcacagccggacatggacagattgacaacttttcactaggagtcttgggaatggcactgttcctggaagaaatgctcaggacccgagtaggaacgaaacatgtaatactgctagtcgcagtatcttttgtgacattgattactgggaacatgtcctttagagacctgggaagagtgatggttatggtgggcgttaccatgacggatgacataggtatgggagtgacttaccttgccttactagcagctttcaaagttagaccaactttcgcagctggactactcttgagaaaactgacctccaaggaattaatgatggccaccataggaatcgcactcctttcccaaagcaccataccagaaaccattcttgaactgactgatgcgttagccctgggcatgatggtcctcaagatagtgagaaatatggaaaagtaccaattggcagtgaccatcatggctatctcgtgtgtcccaaatgcagtgatactgctaaacgcatggaaggtgagttgcacaatattggcagcggtgtccgtttctccattgctcttaacatcctcacagcagaaaacggattggataccactggcattgacgatcaaaggtctcaatccaacagccatctttcttacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcactggacgatcggccgacttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtttttccagtatcgataccaattacggcagcagcatggtacctgtgggaagtgaagaaacaacgggctggagtattgtgggacgtcccttcacccccaccagtggaaaaggctgaactggaagatggagcttatagaatcaagcaaagagggattcttggatattctcagattggagctggagtttacaaagaaggaacattccatacaatgtggcacgtcacacgtggtgctgttctgatgcatagagggaaaaggattgaaccatcatgggcagacgtcaagaaagacctaatatcatatggaggaggctggaagctagaaggagaatggaaagaaggagaggaagtccaagtcctggcattagaacctggaaaaaatccaagagccgtccaaacgaaacctggacttttcaaaaccaacacaggaaccataggcgccgtatctctggacttttcccctggaacgtcaggatctccaattgtcgatagaaaaggaaaagtcgtgggtctttacggtaatggtgttgtcacaaggagtggagcatatgtgagtgctatagcccagaccgaaaaaagcattgaagacaacccagagatcgaagatgactttttccgaaagaaaagattgaccatcatggaccttcatccaggagcaggaaagacaaaaagataccttccagccatagttagagaagccataaaacgtggtttgagaacattaatcctggctcccactagagttgtggcagctgaaatggaggaagctcttagaggacttccaataagataccaaaccccagccatcagaaccgagcacaccgggcgggagatcgtggacctaatgtgtcatgccacatttactatgaggctgctatcaccagtcagagtgccaaattacaacctgatcatcatggacgaagcccacttcacagatccagcaagtatagcagctagaggatatatttcaactcgagtagaaatgggtgaagcagctgggattttcatgacagccactcctccgggaagtagagacccatttcctcagagcaatgcaccaatcatggatgaggaaagagaaatccctgaacgttcgtggaattcaggacatgaatgggtcacggattttaaagggaagactgtttggtttgttccaagtataaaagcaggaaatgacatagcagcttgtctcagaaaaaacggaaagaaagtgatacaactcagtaggaagacttttgactctgagtatgttaagactagaaccaatgattgggactttgtggtcacaactgacatttcagaaatgggtgccaacttcagggctgagagggttatagaccccagacgttgtatgaaaccagtcatactaacagatggcgaagagcgggtgattttggcaggacctatgccagtgacccactctagtgcagcacaaagaagagggagaataggaagaaatccaagaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgacggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacgaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagactctggagacactgcttttactgacactcctggctacagtcacaggagggatcttcttattcttaatgagcggaaaaggtatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttggaaaaggatggccattgtcaaagatggacatcggagttcccctccttgccattggatgctattcacaagtcaaccctataactctcacagcagctcttctgctattggtagcacattatgccattatagggccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaacactactattgcagtgtcaatggctaacatctttagggggagctatttggccggagctggacttctcttttccatcatgaagaacacaacaaacacaagaagaggaactggcaacataggagagacacttggagaaaaatggaaaagccgattaaacacactggggaaaaatgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgtcttcttcaccccgccagaaaagtgtgacacattgttgtgtgacataggggagtcgtcaccaaatcccacgatagaagcaggacgaacactcagagtccttaacttagcggaaaattggttgaacaacaacacccaattttgcataaaggttctcaacccatatatgccctcagtcatagaaaaaatggaaacactacaaaggaaatatggaggagctttagtgaggaatccactctcacgaaactccacacacgagatgtactgggtatccaatgctaccgggaatatagtgtcatcagtgaatatgatttcaaggatgttgattaacagattcacaatgaagcacaagaaagccacctatgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacatgggcttaccatggtagctatgaaacaaaacaaactggatcagcatcatctatggtgaacggagtggtcaggctgctgacaaaaccttgggacgtcgtccctatggtgacacaggtggcaatgacagacacgactccatttggacaacaacgcgtcttcaaagagaaagtggacacgagaacccaagaaccgaaggaaggcacaaagaaactgatgagaattacggcagagtggctttggaaagaactaggaaagaaaaagacacctaggatgtgtaccagagaagaattcacaagaaaggtgagaagcaatgcagccttgggggccatattcactgatgaaaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggattcttgaatgaagatcactggttctccagagagaactccctgagtggagtggaaggagaagggctgcacaggctaggctacattttaagagatgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagcgggcaggtcggcacctatggccttaatactttcaccaacatggaagcccaattaattagacagatggaaggagaaggaatcttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgactggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgcgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 690 - DNA, 10167 bp, Dengue virus
atgaatgaccaacggaaaaaggcgagaaacacgcctttcaatatgctgaaacgcgagagaaaccgcgtgtcaactgtacaacagttgacaaagagattctcacttggaatgctgcagggacgaggaccactaaaattgttcatggccctggtggcattccttcgtttcctaacaatcccaccaacagcagggatattaaaaagatggggaacaattaaaaaatcaaaggctattaatgttctgagaggcttcaggaaagagattggaaggatgctgaatatcttaaacaggagacgtagaactgcaggcatgatcatcatgctgattccaacagtgatggcgtttcatctgaccacacgcaacggagaaccacacatgatcgtcagtagacaagaaaaagggaaaagccttctgtttaagacaaaggacggcacgaacatgtgtaccctcatggccatggaccttggtgagttgtgtgaagacacaatcacgtataaatgtccctttctcaagcagaacgaaccagaagacatagattgttggtgcaactccacgtccacatgggtaacttatgggacatgtaccaccacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggctttaccataatggccgcaatcctggcatacaccataggaacgacgcatttccaaagagtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaataaaccaacactggactttgaactgataaaaacagaagccaaacaacccgccaccttaaggaagtactgtatagaggctaaactgaccaacacgacaacagactcgcgctgcccaacacaaggggaacccaccctgaatgaagagcaggacaaaaggtttgtctgcaaacattccatggtagacagaggatggggaaatggatgtggattatttggaaaaggaggcatcgtgacctgtgccatgttcacatgcaaaaagaacatggagggaaaaattgtgcagccagaaaacctggaatacactgtcgttataacacctcattcaggggaagaacatgcagtcggaaatgacacaggaaaacatggtaaagaagtcaagataacaccacagagctccatcacagaggcggaactgacaggctatggcactgttacgatggagtgctctccaagaacgggcctcgacttcaatgagatggtgttgctgcaaatgaaagacaaagcttggctggtgcacagacaatggttcctagacctaccgttgccatggctgcccggagcagacacacaaggatcaaattggatacagaaagagacactggtcaccttcaaaaatccccatgcgaaaaaacaggatgttgttgtcttaggatcccaagagggggccatgcatacagcactcacaggggctacggaaatccagatgtcatcaggaaacctgctgttcacaggacatcttaagtgcaggctgagaatggacaaattacaacttaaagggatgtcatactccatgtgcacaggaaagtttaaagttgtgaaggaaatagcagaaacacaacatggaacaatagtcattagagtacaatatgaaggagacggctctccatgcaagaccccttttgagataatggatctggaaaaaagacatgttttgggccgcctgaccacagtcaacccaattgtaacagaaaaggacagtccagtcaacatagaagcagaacctccattcggagacagctacatcatcataggagtggaaccaggacaattgaagctggactggttcaagaaaggaagttccatcggccaaatgtttgagacaacaatgaggggagcgaaaagaatggccattttgggcgacacagcctgggattttggatctctgggaggagtgttcacatcaataggaaaggctctccaccaggtttttggagcaatctacggggctgctttcagtggggtctcatggactatgaagatcctcataggagttatcatcacatggataggaatgaactcacgtagcacatcactgtctgtgtcactggtattagtgggaatcgtgacactgtacttgggagttatggtgcaggccgatagtggttgcgttgtgagctggaagaacaaagaactaaaatgtggcagtggaatattcgtcacagataacgtgcatacatggacagaacaatacaagttccaaccagaatccccttcaaaactggcttcagccatccagaaagctcatgaagagggcatctgtggaatccgctcagtaacaagactggaaaatcttatgtggaaacaaataacatcagaattgaatcatattctatcagaaaatgaagtgaaactgaccatcatgacaggagacatcaaaggaatcatgcaggtaggaaaacgatctctgcggcctcaacccactgagttgaggtattcatggaaaacatggggtaaagcgaaaatgctctccacagaactccataatcagaccttcctcattgatggtcccgaaacagcagaatgccccaacacaaacagagcttggaattcactagaagttgaggactacggctttggagtattcactaccaatatatggctaagattgagagaaaagcaggatgcattttgtgactcaaaactcatgtcagcggccataaaggacaacagagccgtccatgctgatatgggttattggatagaaagcgcactcaatgatacatggaagatagagaaagcttctttcattgaagtcaaaagttgccactggccaaagtcacacactctatggagtaatggagtgctagaaagcgagatggtaattccaaagaatttcgctggaccagtgtcacaacataataacagaccaggctatcacacacaaacagcaggaccttggcatctaggcaagcttgagatggactttgatttctgcgaagggactacagtggtggtaaccgaggactgtggaaacagagggccctctttaagaacaaccactgcctcaggaaaactcataacggaatggtgttgtcgatcttgcacactaccaccactaagatacagaggtgaggatggatgctggtacgggatggaaatcagaccattgaaagagaaagaagaaaatctggtcagttctctggtcacagccggacatgggcagattgataatttctcattaggaatcttgggaatggcactgttccttgaagaaatgctcaggactcgagtaggaacgaaacatgcaatattactagtcgcagtttctttcgtaacgttaatcacagggaacatgtcttttagagacctgggaagagtgatggttatggtgggtgccaccatgacagatgacataggcatgggtgtgacttatcttgctctactagcagctttcaaagtcagaccaacctttgcagctggactgctcttgagaaaactgacctccaaggaattaatgatgaccaccataggaatcgttcttctctcccagagtagcataccagagaccattcttgaactgaccgatgcgttagctttaggcatgatggtcctcaagatggtgagaaacatggaaaaatatcagctggcagtgaccatcatggctattttgtgcgtcccaaatgctgtgatattacagaacgcatggaaagtgagttgcacaatattggcagtggtgtctgtttcccccctgttcttaacatcctcacaacagaaagcggactggataccattagcgttgacgatcaaaggcctcaatccaacagccatttttctaacaaccctctcaagaaccagcaagaaaaggagctggcctttaaatgaggccatcatggcggttgggatggtgagtatcttggccagctctctcttaaagaatgacacccccatgacaggaccattagtggctggagggcttcttactgtgtgctacgtactaactgggcggtcagccgatctggaactagagagagctaccgatgtcaaatgggatgaccaggcagagatatcaggtagcagtccaattctgtcaataacaatatcagaagatggcagcatgtcaataaagaatgaagaggaagagcaaacattgactatactcattagaacaggattgcttgtgatctcaggactctttccggtatcaataccaattacagcagcagcatggtacctgtgggaagtaaagaaacaacgggctggagtgttgtgggatgtcccctcaccaccacccgtgggaaaggctgaattggaagatggagcctacagaatcaagcaaaaaggaatccttggatattcccagatcggagctggagtttacaaagaaggaacatttcacacaatgtggcacgtcacacgtggcgctgtcctaatgcataaggggaagaggattgaaccatcatgggcggacgtcaagaaagacttaatatcatatggaggaggttggaagctagaaggagaatggaaagaaggagaagaagtccaggtcttggcattggagcctgggaaaaatccaagagccgtccaaacaaaacctggcctttttagaaccaatactggaaccataggtgccgtatctctggacttttcccctgggacgtcaggatctccaatcgtcgacaaaaaaggaaaagttgtaggcctctatggcaatggtgtcgttacaaggagtggagcatatgtgagtgccatagctcagactgaaaaaagcattgaagacaatccagagattgaagatgacatctttcgaaagagaagattgactatcatggatctccacccaggagcaggaaagacaaagagatacctcccggccatagtcagagaggccataaaaagaggcttgagaacactaatcctagcccccactagagtcgtggcagctgaaatggaggaagcccttagaggacttccaataagataccaaactccagctatcagggctgagcacaccgggcgggagattgtggacttaatgtgtcatgccacatttaccatgaggctgctatcaccaatcagggtgccaaattacaacctgatcatcatggacgaagcccattttacagatccagcaagcatagcagctaggggatacatctcaactcgagtggagatgggtgaggcagctggaatttttatgacagccactcctccgggtagcagagatccatttcctcagagtaatgcaccaattatggacgaagaaagagaaatcccggaacgttcatggaactccgggcacgagtgggtcacggattttaaaggaaagactgtctggtttgttccaagcataaaaaccggaaatgacatagcagcctgcctgagaaagaatggaaagagggtgatacaactcagtaggaagacctttgattctgaatatgtcaagactagaaccaatgactgggatttcgtggttacaactgacatctcggaaatgggtgccaactttaaagctgagagggttatagaccccagacgctgcatgaaaccagttatactgacagacggcgaagagcgggtgattctggcaggacccatgccagtgacccactctagtgcagcacaaagaagagggagaataggaaggaatccaaggaatgaaaatgatcaatatatatatatgggggaacccctggaaaatgatgaagactgtgcgcactggaaggaagctaagatgctcctagataacatcaacacacctgaaggaatcattcccagcatgttcgagccagagcgtgaaaaggtggatgccattgacggtgaatatcgcttgagaggagaagcacggaaaacttttgtggacctaatgagaagaggagacctaccagtctggttggcttataaagtggctgctgaaggtatcaactacgcagacagaagatggtgttttgacggaaccagaaacaatcaaatcttggaagaaaatgtggaagtggaaatctggacaaaggaaggggaaaggaaaaaattgaaacctagatggttagatgctaggatctactccgacccactggcgctaaaagaattcgcagccggaagaaagtccctaaccctgaacctaatcacagagatgggcagactcccaacttttatgactcagaaggccagagatgcactagacaacttggcggtgctgcacacggctgaagcgggtggaaaggcatacaatcatgctctcagtgaactaccggagaccctggagacattgcttttgctgacactgttggccacagtcacgggaggaatctttctattcctgatgagcggaaggggtatagggaagatgaccctgggaatgtgctgcataatcacggccagcatcctcttatggtatgcacaaatacaaccacattggatagcagcttcaataatattggagttctttctcatagtcttgctcattccagaaccagaaaagcagaggacaccccaggataaccaattgacttatgtcatcatagccatcctcacagtggtggccgcaaccatggcaaacgaaatgggttttctggaaaaaacaaagaaagacctcggactgggaaacattgcaactcagcaacctgagagcaacattctggacatagatctacgtcctgcatcagcatggacgttgtatgccgtggccacaacatttatcacaccaatgttgagacatagcattgaaaattcctcagtaaatgtgtccctaacagccatagctaaccaagccacagtgctaatgggtctcgggaaaggatggccattgtcaaagatggacattggagttcccctccttgctattgggtgttactcacaagtcaaccctataaccctcacagcggctcttcttttattggtagcacattatgccatcataggaccgggacttcaagccaaagcaaccagagaagctcagaaaagagcagcagcgggcatcatgaaaaacccaactgtggatggaataacagtgatagatctagatccaataccctatgatccaaagtttgaaaagcagttgggacaagtaatgctcctagtcctctgtgtgacccaagtgctgatgatgaggactacgtgggctttgtgtgaagccttaactctagcaaccggacccgtgtccacattgtgggaaggaaatccagggagattctggaacacaaccattgcagtgtcaatggcaaacatctttagagggagttacctggctggagctggacttctcttttctatcatgaagaacacaaccagcacgagaagaggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtggtag

SEQ ID NO: 691 - DNA, 10176 bp, Dengue virus
atgaataaccaacggaaaaaggcgagaaatacgcctttcaatatgctgaaacgcgagagaaaccgcgtgtcaactgtgcagcagctgacaaagagattctcacttggaatgctacagggacgaggaccattgaaactgttcatggccctggtggcattccttcgtttcctaacaatcccgccaacagcagggatattaaaaagatggggaacaatcaaaaaatcaaaggctatcaatgtcttgagagggttcaggaaagagattggaaggatgctgaacatcttgaacaggagacgcagaactgcaggtataatcattatgatgattccaacagtgatggcgttccatttaaccacacgcaacggagaaccacacatgatcgtcagtagacaagaaaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccgcatgtgggaatgggactggagacacgaactgaaacatggatgtcatcagaaggggcctggaaacatgcgcagagaattgaaacttgggtcttgagacatccaggcttcaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttggaacatggaagctgtgtgacaacgatggcgaaaaataaaccaacattggattttgaactgataaagacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaaaggaggtatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggcaaggaaattaaagtaacaccacaaagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcacttttaaaaatccccatgcaaagaaacaggatgttgttgttttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagtcatcagagtacaatatgaaggggacggttctccatgcaagatcccttttgaaataatggatttggaaaaaagacatgtcttaggtcgcttgatcacagtcaacccaattgtcacagaaaaagacagcccagtcaacatagaagcagaacctccattcggagacagctacatcattataggagtagagccgggacaactgaagctcagctggtttaagaaaggaagttctattggccaaatgtttgagacaacaatgagaggagcgaagagaatggccattttaggtgacacagcttgggattttggatccttgggaggagtgtttacatctataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggagtagtgacattgtatttgggagttatggtgcaggccgatagtggttgcgttgtgagttggaaaaacaaagaactgaaatgtggcagtgggatttttgtcacagacaacgtgcacacgtggacagaacaatacaaattccagccagaatccccttcaaaactggcttcagctatccagaaggcccatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcggcctcaacccactgagctgaagtactcgtggaaaacatggggcaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaattgaaagaaaggcaggatgtattttgtgactcaaaactcatgtcagcagccataaaagacaacagagccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccatggcatctaggcaggcttgagatggactttgatttctgcgaaggaaccacagtggtggtgactgaggactgtggaaatagaggaccctctttaagaacaactactgcttctggaaaactcataacagaatggtgctgccgatcttgcacattaccaccgctaaggtacagaggtgaggatggatgttggtatggaatggaaatcagaccattgaaagagaaagaagagaacttggtcaactctttggtcacagccggacatggacagattgacaacttctcactaggagtcttgggaatggcattgttcctggaagagatgctcaggacccgagtgggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccgacttttgcagctggactactcttaaggaagctgacctccaaggaattgatgatgaccaccataggaattgtactcctctctcagagcaccataccagagactatacttgaactgactgacgcgttggctttagggatgatggttctcaaaatagtaagaaacatggaaaagtatcaactagcagtgaccatcatggctatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctcgcaagaactagcaagaaaaggagctggccactaaatgaggctattatggcagtcgggatggtgagcattttagccagttctctcttaaaaaatgatattcccatgacaggaccattagtggctggagggcttctcactgtgtgttacgtgctcactggaagatcggctgatttggaactggagagagctgctgacgtaagatgggaagaacaggcagagatatcaggaagcagtccaattctgtcgataacaatatcggaagatggtagcatgtcgataaaaaatgaagaagaagaacaaacactgaccatacttattagaacaggactgctggtgatatcaggactttttcccgtgtcaataccaatcacggcagctgcatggtacctgtgggaagtgaaaaaacaacgagccggagtgctgtgggatgtcccttcacctccacctgtgggaaaagccgaactggaagatggagcctatagaatcaagcagaaagggattctaggatactcgcagatcggagctggagtttacaaagaaggaacattccacacaatgtggcatgtcacacgtggtgctgttcttatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagcggaacatatgtgagcgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccatttcctcagagcaacgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaaagatggaaagaaagtgatacaactcagcaggaagacctttgactctgaatatattaagactagaaccaatgattgggactttgtggtcacgacagacatttcagaaatgggtgccaacttcaaggctgagagggttatagaccccagacgctgcatgaaaccagtcatactaacagacggtgaagaacgggtgatcttggcaggacccatgccagtgacccactctagtgcagcacaaagaagagggagagttggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggacgccattgatggtgaataccgcttgagaggagaagcgaggaaaacatttgtggacctaatgagaagaggagacctaccagtctggctagcctacagagtggcagctgaaggtattaactacgcagacagaagatggtgctttgatggagtcaagaacaaccaaatcctggaagaaaatgtggaagtggaaatttggacaaaagaaggagaaaggaagaaattaaaacccagatggttggatgctaggatctactctgacccactagcgctcaaagaattcaaggaattcgcagctggaagaaaatccctgaccttgaatctaatcaccgagatgggtaggctcccaaccttcatgacccagaaagcaaggaatgcattggacaacttagcagtcctgcatacggctgaaacaggcggaagggcgtacaatcatgctcttagtgaactgccggagactctggagacattgcttttactgacacttttggccacagtcacgggcggaatcttcctgttcttgatgagcggaaaaggtatagggaagatgaccctgggaatgtgctgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatcctcacagtggtggccgcaaccatggcaaatgagatgggtttcctagaaaaaacaaagaaagatttcggattgggaagcattacaacccagcaacctgagagcaacatcctggacatagatctacgtcctgcatcagcttggactctatatgccgtggcaacaactttcatcacaccaatgttgagacacagcattgaaaattcctcagtgaatgtgtctctaacagccattgccaaccaggccacagtgttaatgggccttgggaaaggatggccattgtcaaaaatggacatcggagttccccttctcgctatcggatgctattcacaagtcaaccccataactctcacagcagcccttctcttattggtagcacattatgctatcatagggccaggactccaggcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtactggtgatgaggactacatgggctttatgtgaagctctaaccttagcaaccgggcccatctctacactgtgggaaggaaatccaggaagattctggaatacaactattgcagtgtcaatggctaacatttttagagggagttacctggccggagccggacttctcttttctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcacgctgtgtcgcgaggctcggcgaaactgagatggttcgtcgagagaaacttggtcacaccagaagggaaagtagtggaccttggctgcggcagggggggctggtcatactattgtgggggactaaagaatgtaaaagaagtcaaaggcctaacaaaaggaggaccaggacacgaagagcccattcccatgtcaacatatggttggaatctggtgcgtcttcaaagtggagttgatgtcttttttactccgccagaaaagtgtgacacattgctgtgtgacataggggagtcgtcaccaaaccccacggttgaggcaggacgaacactcagagttctaaacttagtggaaaactggctgaacaacaacacccaattttgcataaaggttctcaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagacgttgatctcggaagtggaacccgcaacatcggaattgaaagtgagacaccaaatttagacataattggaaaaagaatagaaaaaataaaacaagagcatgaaacatcatggcactatgaccaagaccacccatacaaaacgtgggcttaccatggcagctatgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggtacgaaaaaactaatgaaaatcacggcagaatggctctggaaagaactaggaaagaaaaagacacctaggatgtgcaccagagaagaattcacaagaaaggtgagaagcaatgcagccttaggtgccatatttactgatgagaacaagtggaagtcggcacgtgaggctgttgaagacagtgaattttgggaattggttgacaaggaaaggaatctccatcttgaaggaaagtgtgagacatgtgtgtataacatgatgggaaagagagagaagaagttaggggagttcggcaaagcaaaaggcagcagagccatatggtacatgtggcttggagcacgcttcttagagtttgaagccctaggatttttgaatgaagatcactggttttccagagagaactccctgagtggagtggaaggagaagggctgcacaaactaggctacattttaagagacgtgagtaagaaagaaggaggagcaatgtacgccgatgacactgcaggatgggacacaagaatcacactagaggacttaaaaaatgaagaaatggtgacaaaccacatggaaggagaacataagaaacttgctgaagccattttcagattaacgtaccaaaacaaggtggtgcgtgtgcaaagaccgacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcacctgacagttacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttctagaggatggaacgattggacacaagtgcccttttgttcacaccatttccatgagttaatcatgaaggacggtcgtgtacttgtagttccatgtagaaaccaagatgaactgattggtagggcccgaatttcccagggagccgggtggtccttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaatccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 692 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgttatgttgattccaacagcgatggcgttccatttaaccacacgcaatggagaaccacacatgatcgtcggcaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggctaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtacagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgctaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaatcgtgaaagaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacctccattcggagacagctacatcattataggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcgctggaagttgaagactatggttttggagttttttccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccatgccagagaccattcttgaactgactgatgcgttagccttgggcatgatggtcctcaaaatagtgagaaatatggaaaaataccaattggcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagtattgaagacaatccagagatcgaagatgacattttccgaaagaaaagattgaccatcatggacctccatccaggagcaggaaagacaaaaagataccttccagccatagttagagaagccataaatcgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcacgccacatttactatgaggctgctatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagcaggaagacttttgactctgagtatgttaagactagagccaatgattgggactttgtggtcacaactgacatttcagaaatgggtgctaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacttttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacagctagcagcctcctatggtatgcacagatccaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtagctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattgaacgcactgggaaaaagtgaatttcagatctacaagaaaagtggaatccaggaagtggatagaaccctagcaaaagaaggtatcaaaagaggagaaacggaccaccatgctgtgtcacgaggatcagcaaaactgagatggttcgtcgagagaaatatggtcacaccggaagggaaggtggtggatctcggttgcggcagagggggatggtcatactattgtgggggactaaagaatgtaagagaagtcaaaggcctaacaaaaggaggaccaggacacgaagaacctatccccatgtcaacatatgggtggaatctagtgcgtctgcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaactcgcaacattggaattgaaagtgagataccaaatctagacataataggaaagagaatagagaaaataaagcaagaacatgaaacatcatggcattatgaccaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggaactggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcatctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaagccaagatgaactgattggcagagcccgcatttcccagggagccgggtggtctttgaaggagacagcctgtttggggaagtcttacgcccaaatgtggaccctgatgtacttccacagacgtgacctcagactggcggcaaatgccatttgctcggcagtcccgtcacattgggttccaacaagccgaacaacctggtccatacacgccaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 693 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgttatgttgattccaacagcgatggcgttccatttaaccacacgcaatggagaaccacacatgatcgttggcaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggctaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtacagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgctaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaatcgtgaaagaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacctccattcggagacagctacatcattataggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccatgccagagaccattcttgaactgactgatgcgttagccttgggcatgatggtcctcaaaatagtgagaaacatggaaaaataccaattggcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagtattgaagacaatccagagatcgaagatgacattttccgaaagaaaagattgaccatcatggacctccatccaggagcaggaaagacaaaaagataccttccagccatagttagagaagccataaatcgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcacgccacatttactatgaggctgctatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagcaggaagacttttgactctgagtatgttaagactagagccaatgattgggactttgtggtcacaactgacatttcagaaatgggtgctaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacttttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtataggaaagatgaccctgggaatgtgttgcataatcacagctagcagcctcctatggtatgcacagatccaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtagctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgtgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattgaacgcactgggaaaaagtgaatttcagatctacaagaaaagtggaatccaggaagtggatagaaccctagcaaaagaaggtatcaaaagaggagaaacggaccaccatgctgtgtcacgaggatcagcaaaactgagatggttcgtcgagagaaatatggtcacaccggaagggaaggtggtggatctcggttgcggcagagggggatggtcatactattgtgggggactaaagaatgtaagagaagtcaaaggcctaacaaaaggaggaccaggacacgaagaacctatccccatgtcaacatatgggtggaatctagtgcgtcttcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaactcgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggcagagcccgcatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 694 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaagagatggggaacgatcaaaaaatcaaaagctatcaatgttttgagagggttcaggaaagagattggaaggatgctgaacatcttgaacaggagacgcaggacagcaggcgtgattgttatgttgattccaacagcgatggcgttccatttaaccacacgcaatggagaaccacacatgatcgttggcaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggctaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtacagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgctaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaatcgtgaaagaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacctccattcggagacagctacatcattataggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcgctggaagttgaagactatggttttggagttttttccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccatgccagagaccattcttgaactgactgatgcgttagccttgggcatgatggtcctcaaaatagtgagaaatatggaaaaataccaattggcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagtattgaagacaatccagagatcgaagatgacattttccgaaagaaaagattgaccatcatggacctccatccaggagcaggaaagacaaaaagataccttccagccatagttagagaagccataaatcgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcacgccacatttactatgaggctgctatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagcaggaagacttttgactctgagtatgttaagactagagccaatgattgggactttgtggtcacaactgacatttcagaaatgggtgctaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacttttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacagctagcagcctcctatggtatgcacagatccaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtagctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattgaacgcactgggaaaaagtgaatttcagatctacaagaaaagtggaatccaggaagtggatagaaccctagcaaaagaaggtatcaaaagaggagaaacggaccaccatgctgtgtcacgaggatcagcaaaactgagatggttcgtcgagagaaatatggtcacaccggaagggaaggtggtggatctcggttgcggcagagggggatggtcatactattgtgggggactaaagaatgtaagagaagtcaaaggcctaacaaaaggaggaccaggacacgaagaacctatccccatgtcaacatatgggtggaatctagtgcgtctgcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaactcgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggaactggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcatctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggcagagcccgcatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 695 - DNA, 10176 bp, Dengue virus
atgaataaccaacggaaaaaggcgagaaacacgcctttcaatatgctgaaacgcgagagaaaccgcgtgtcaactgtacaacagttgacaaagagattctcacttggaatgctgcagggacgaggaccactaaaattgttcatggccctggtggcattccttcgtttcctaactatcccaccaacagcagggatattgaaaagatggggaacaatcaaaaaatcaaaggctattaatgttctaagaggcttcaggaaagagattggaaggatgctgaatatcttaaacaggagacgtagaactgcaggcatgatcatcatgctgattccaacagtgatggcgtttcatctgaccacacgcaacggagaaccacacatgatcgtcagtagacaagaaaaagggaaaagccttctgtttaagacaaaggatggcacgaacatgtgtactctcatggccatggaccttggtgagttgtgtgaagacacaatcacgtataagtgtccttttctcaagcagaacgaaccagaagacatagattgttggtgcaactccacgtccacatgggtaacttacgggacatgtaccaccacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggctttaccataatggccgcaatcctggcatacaccataggaacgacgcatttccaaagagtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaataaaccaacattggactttgaactgataaaaacagaagccaaacaacccgccaccttaaggaagtactgtatagaggctaaactgaccaacacgacaacagactcgcgttgcccaacacaaggggaacccaccctgaatgaagagcaggacaaaaggtttgtctgcaaacattccatggtagacagaggatggggaaatggatgtggattgtttggaaaaggaggcatcgtgacctgtgctatgttcacatgcaaaaagaacatggaaggaaaaattgtgcagccagaaaacctggaatacactgtcgtgataacacctcattcaggggaagaacatgcagtcggaaatgacacaggaaaacatggtaaagaagtcaagataacaccacagagctccatcacagaggcggaactgacaggctatggcactgtaacgatggagtgctctccaagaacgggcctcgacttcaatgagatggtgttgctgcaaatggaagacaaagcttggctggtgcacagacaatggttcctagacctaccgttgccatggctgcccggagcagacacacaaggatcaaattggatacagaaagagacattggtcaccttcaaaaatccccatgcgaaaaaacaggatgttgttgtcctaggatcccaagagggggccatgcatacagcactcacaggggccacggaaatccagatgtcatcaggaaacctgctgttcacaggacatctcaaatgcaggctgagaatggacaaattacaacttaaagggatgtcatactccatgtgcacaggaaaatttaaaattgtgaaggaaatagcagaaacgcaacatggaacaatagtcattagagtacaatatgaaggagacggctctccatgcaagatcccttttgagataatggatctggaaaaaagacatgttttgggccgcctgatcacagtcaacccaattgtaacagaaaaggacagtccagtcaacatagaagcagaacctccattcggagacagctacatcatcataggagtggaaccaggacaattaaagctggactggttcaagaaaggaagttccatcggtcaaatgtttgagacaacaatgaggggagcgaaaagaatggccatcttgggcgacacagcctgggattttggatctctgggaggagtgttcacatcaataggaaaagctctccaccaggtttttggagcaatctacggggctgctttcagtggggtttcatggactatgaagatccttataggagttatcatcacatggataggaatgaactcacgtagcacatcactgtctgtgtcactggtattagtgggaatcgtgacactgtacttgggagttatggtgcaagccgatagtggttgcgttgtgagctggaagaacaaagaactaaaatgtggcagtggaatattcgtcacagataacgtgcatacatggacagaacaatacaagttccaaccagaatccccttcaaaactggcttcagccatccagaaagctcacgaagaaggcatctgtggaatccgctcagtaacaagactggaaaatcttatgtggaaacagataacatcagaattgaatcatattctatcagaaaatgaagtgaaactgaccatcatgacaggagacatcaaaggaatcatgcaggtaggaaaacgatctctgcggcctcaacccactgagttgaggtattcatggaaaacatggggtaaagcgaaaatgctctccacagaactccacaatcagaccttcctcattgatggtcccgaaacagcagaatgccccaacacaaacagagcttggaattcactagaagttgaggactatggctttggagtattcactaccaatatatggctaagattgagagaaaagcaggatgcattttgtgacccaaaactcatgtcagcggccataaaggacaacagagccgtccatgctgatatgggttattggatagaaagcgcactcaatgatacatggaagatagagaaagcttctttcattgaagtcaaaagttgccactggccaaagtcacacactctatggagtaatggagtgctagaaagcgagatggtaattccaaagaatttcgctggaccagtgtcacaacataataacagaccaggctatcacacacaaacagcaggaccttggcatctaggcaagcttgagatggactttgatttctgcgaagggaccacagtggtggtaaccgaggaatgtggaaacagagggccttctttaagaacaaccactgcctcaggaaaactcataacggaatggtgttgtcgatcttgcacactaccaccactaagatacagaggtgaggatggatgctggtacgggatggaaatcagaccattgaaagagaaagaagaaaatctggtcagttctctggtcacagccggacatgggcagattgataatttctcattaggaatcttgggaatggcgctgttccttgaagaaatgctcaggactcgagtaggaacgaaacatgcaatactactagtcgcagtctctttcgtaacgttaatcacagggaacatgtcttttagagacctgggaagagtgatggttatggtgggtgccaccatgacagatgacataggcatgggtgtgacttatcttgctctactagcagccttcaaagtcagaccaacctttgcagctggactgctcttgagaaaactgacctccaaggaattaatgatgaccaccataggaatcgttcttctctcccagagtagcataccagagaccattcttgagctgaccgatgcgttagccttaggcatgatggtcctcaagatggtgagaaacatggaaaaatatcagctggcagtgactatcatggctattttgtgcgtcccaaatgctgtgatattacagaacgcatggaaagtgagttgcacaatactggcagtggtgtctgtttcccccctgctcttgacatcctcacagcagaaagcggactggataccattagcgttgacgatcaaaggcctcaatccaacagccatttttctaacaaccctctcaagaaccagcaagaaaaggagctggcctttaaacgaggccatcatggcggttgggatggtgagtatcttggccagctctctcttgaagaacgacatccccatgacaggaccattagtggctggagggcttcttactgtgtgctacgtactaactgggcggtcagccgatctggaactagagagagctaccgatgtcaaatgggatgatcaggcagagatatcaggtagcagtccaattctgtcaataataatatcagaagatggcagcatgtcaataaagaatgaagaggaagagcaaacactgaccatactcattagaacaggattgcttgtgatctcaggactctttccggtatcaataccaattacagcagcagcatggtacctgtgggaagtaaagaaacaacgggctggagtgttgtgggatgtcccctcaccaccacccgtgggaagggctgaattggaagatggagcctacagaatcaagcaaaaaggaattcttggatattcccagatcggagctggagtttacaaagaaggaacatttcacaccatgtggcacgtcacacgtggcgcagtcctaatgcataaggggaagaggattgaaccatcatgggcggacgtcaagaaagacttaatatcatatggaggaggttggaagctagaaggagaatggaaagaaggagaagaagtccaggtcttggcattggagcctgggaaaaatccaagagccgtccaaacaaaacctggcctttttagaaccaatactggaaccataggcgccgtatctctggacttttcccctgggacgtcaggatctccaatcgttgacaaaaaaggaaaagttgtaggtctctatggcaatggtgttgttacaaggggtggagcatatgtgagtgccatagctcagactgaaaaaagcattgaagacaatccagagattgaagatgacatctttcgaaagagaagattgactatcatggatctccacccaggagcaggaaagacaaagagatacctcccggccatagttagagaggccataaaaagaggcttgagaacactaatcctagcccccactagagtcgtggcagctgaaatggaggaagcccttagaggacttccaataagataccaaactccagccatcagggctgagcacaccgggcgggagatcgtggacttaatgtgtcatgccacatttaccatgaggctgctatcaccaatcagggtgccaaattacaacctgatcatcatggacgaagcccattttacagatccagcaagcatagcagctaggggatacatctcaactcgagtggagatgggtgaggcagctggaatttttatgacagccactcctccgggtagcagagatccatttcctcagagtaatgcaccaatcatggacgaagaaagagaaattccggaacgttcatggaactccgggcacgagtgggtcacggatttcaaaggaaagactgtctggtttgttccaagcataaaaaccggaaatgacatagcagcctgcctgagaaagaatggaaagagggtgatacaactcagtaggaagacctttgattctgaatacgtcaagactagaaccaatgactgggatttcgtggttacaactgacatttcggaaatgggtgccaactttaaagctgagagggttatagaccccagacgctgcatgaaaccagttatactgacagacggcgaagagcgggtgattctagcaggacccatgccagtgacccactccagtgcagcacaaagaagagggagaataggaaggaatccaaggaatgaaaatgatcaatacatatatatgggagaacccctggaaaatgatgaagactgtgcgcactggaaggaagctaagatgctcctagataacatcaacacacctgaaggaatcattcccagcatgttcgagccagagcgtgaaaaggtggatgccattgacggtgaatatcgcttgagaggagaagcacggaaaacttttgtggacctaatgagaagaggagacctaccagtctggttggcttataaagtggcagctgaaggtatcaactacgcagacagaagatggtgttttgacggaaccagaaataatcaaatcttggaagaaaatgtggaagtggaaatctggacaaaggaaggggaaaggaaaaaattgaaacctagatggttagatgctaggatctactccgacccactggcgctaaaagaattcaaggaattcgcagccggaagaaagtccttaaccctgaacctaatcacagagatgggcagactcccaacttttatgactcagaaggccagagatgcactagacaacttagcggtgctgcacacggctgaagcgggtggaaaagcatacaatcatgccctcagtgaactaccggagaccctggagacattgcttttgctgacactgttggccacagtcacgggaggaatctttctattcctgatgagcggaaggggtatagggaagatgaccctgggaatgtgctgcataatcacggccagcatactcttatggtatgcacaaatacaaccacattggatagcagcttcaataatattggagttctttctcatagtattgctcattccagaaccagagaagcagaggacaccccaggataatcaattgacttatgtcatcatagccatcctcacagtggtggccgcaaccatggcaaacgaaatgggttttctagaaaaaacaaagaaagacttcggactgggacacattgcaactcagcaacctgagagcaacattctggacatagatctacgtcctgcatcagcatggacgttgtatgccgtggcaacaacatttatcacaccaatgttgagacatagcattgaaaattcctcagtaaatgtgtccctaacagccatagctaaccaagccacagtgctaatgggtctcgggaaaggatggccattgtcaaagatggacattggagttcccctccttgccattgggtgttactcacaagtcaaccctataactctcacagcggctcttcttttgttggtagcacattatgccatcataggaccgggacttcaagccaaagcaaccagagaagctcagaaaagagcagcggcgggcatcatgaaaaacccaactgtggatggaataacagtgatagatctagatccaataccctatgatccaaagtttgaaaagcagttgggacaagtaatgctcctagtcctttgtgtgacccaagtgctgatgatgaggactacgtgggctttgtgtgaagccttaactctagcaaccggacccgtgtccacattgtgggaaggaaatccagggagattctggaacacaaccattgcagtgtcaatggcaaacatcttcagagggagttaccttgctggagctggacttctcttttctatcatgaagaacacaaccagcgcgagaagaggaactggcaacatgggagaaacgctaggagagaaatggaaaagcagactgaacgcattggggaaaagtgaattccagatctacaaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattgaagaatgtaagagaagttaaaggcttaacaaaaggaggaccaggacacgaagaacctatccctatgtcaacatatgggtggaatctagtacgcttacagagcggagttgatgttttttttgttccaccagagaagtgtgacacattgttgtgtgacataggggaatcatcaccaaatcccacggtagaggcgggacgaacactcagagtccttaacctagtggaaaattggctgaacaataacacccaattttgcgtaaaggttcttaacccgtacatgccctcagtcattgaaagaatggaaaccttacaacggaaatacggaggagccttggtgagaaatccactctcacggaattccacacatgaaatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaacattggaattgaaagtgagacaccgaacctagacataattgggaaaagaatagaaaaaataaaacaggagcatgaaacgtcatggcactatgaccaagaccacccatacaaaacatgggcttaccatggtagctatgaaacaaaacagacaggatcagcatcatccatggtgaacggagtagtcagactgctgacaaagccctgggacgttattccaatggtgacacagatggcaatgacagacacaactcctttcggacaacagcgtgtcttcaaagagaaggtggatacgagaacccaagaaccaaaagaaggcacaaaaaaactaatgaaaatcacagcagagtggctctggaaagaactaggaaagaaaaagacacctagaatgtgcaccagagaagaattcacaaaaaaggtaagaagtaatgcagccttgggggccatatttaccgatgagaacaagtggaagtcggcgcgtgaggctgttgaagacaataggttttgggagctggttgacaaggaaagaaacctccatcttgaaggaaaatgtgaaacatgtgtatacaacatgatgggaaaaagagagaaaaaactaggagagtttggtaaagcaaaaggcagcagagccatatggtacatgtggctcggagcacgcttcttagagtttgaagccctaggatttttgaatgaagaccattggttctccagagagaactccctgagtggagtggaaggagaagggctgcataaactaggttacatcttaagagaggtgagcaagaaagaaggaggagcaatgtatgccgatgataccgcaggctgggacacaagaatcacaatagaggatttaaaaaatgaagaaatgataacgaaccacatggcaggagaacacaagaaacttgccgaggccatttttaaattgacgtaccaaaacaaggtggtgcgtgtgcaaagaccaacaccaagaggcacggtaatggacatcatatcgagaaaagaccaaaggggtagtggacaagttggcacctatggcctcaacactttcaccaacatggaagcacaactaattaggcaaatggagggggaaggaatcttcaaaagcatccagcacttgacagcctcagaagaaatcgctgtgcaagattggctagtaagagtagggcgtgaaaggttgtcaagaatggccatcagtggagatgattgtgttgtgaaacctttagatgatagatttgcaaaagctctaacagctctaaatgacatgggaaaggttaggaaggacatacagcaatgggagccctcaagaggatggaacgactggacacaggtgcccttctgttcacaccattttcacgagttaattatgaaagatggtcgcacacttgtagttccatgcagaaatcaagatgaattgatcggcagagcccgaatttcccagggagctgggtggtctttacgggagacggcctgtttgggaaagtcttacgcccaaatgtggagcttgatgtacttccacagacgtgatctcaggctagcggcaaatgccatttgctcggcagtcccgtcacactgggttccaacaagccggacaacctggtctatacacgccagccatgaatggatgacgacggaagacatgttgacagtttggaacagagtgtggatcctagagaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagatttagaagagaagaggaagaggcaggagttttgtggtag

SEQ ID NO: 696 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgttatgttgattccaacagcgatggcgttccatttaaccacacgcaatggagaaccacacatgatcgttggcaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggctaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtacagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgctaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaatcgtgaaagaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacctccattcggagacagctacatcattataggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcgctggaagttgaagactatggttttggagttttttccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccatgccagagaccattcttgaactgactgatgcgttagccttgggcatgatggtcctcaaaatagtgagaaatatggaaaaataccaattggcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcgataacaatatcagaagatggcagcatgtcgataaaaaatgaagaggaagagcaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagtattgaagacaatccagagatcgaagatgacattttccgaaagaaaagattgaccatcatggacctccatccaggagcaggaaagacaaaaagataccttccagccatagttagagaagccataaatcgtggcttgagaacattaatcctggctcccactagagtcgtggcagctgagatggaggaagctcttagaggacttccaataagataccaaaccccagccatcagagccgagcacaccgggcgggagatcgtggacctaatgtgtcacgccacatttactatgaggctgctatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagcaggaagacttttgactctgagtatgttaagactagagccaatgattgggactttgtggtcacaactgacatttcagaaatgggtgctaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacttttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtataggaaagatgaccctgggaatgtgttgcataatcacagctagcagcctcctatggtatgcacagatccaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtagctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgtgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattgaacgcactgggaaaaagtgaatttcagatctacaagaaaagtggaatccaggaagtggatagaaccctagcaaaagaaggtatcaaaagaggagaaacggaccaccatgctgtgtcacgaggatcagcaaaactgagatggttcgtcgagagaaatatggtcacaccggaagggaaggtggtggatctcggttgcggcagagggggatggtcatactattgtgggggactaaagaatgtaagagaagtcaaaggcctaacaaaaggaggaccaggacacgaagaacctatccccatgtcaacatatgggtggaatctagtgcgtctgcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaactcgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggaactggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcatctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggcagagcccgcatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 697 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgttatgttgattccaacagcgatggcgttccatttaaccacacgcaatggagaaccacacatgatcgttggcaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggctaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtacagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgctaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaatcgtgaaagaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacctccattcggagacagctacatcattataggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccatgccagagaccattcttgaactgactgatgcgttagccttgggcatgatggtcctcaaaatagtgagaaacatggaaaaataccaattggcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagtattgaagacaatccagagatcgaagatgacattttccgaaagaaaagattgaccatcatggacctccatccaggagcaggaaagacaaaaagataccttccagccatagttagagaagccataaatcgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcacgccacatttactatgaggctgctatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagcaggaagacttttgactctgagtatgttaagactagagccaatgattgggactttgtggtcacaactgacatttcagaaatgggtgctaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacttttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacagctagcagcctcctatggtatgcacagatccaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtagctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattgaacgcactgggaaaaagtgaatttcagatctacaagaaaagtggaatccaggaagtggatagaaccctagcaaaagaaggtatcaaaagaggagaaacggaccaccatgctgtgtcacgaggatcagcaaaactgagatggttcgtcgagagaaatatggtcacaccggaagggaaggtggtggatctcggttgcggcagagggggatggtcatactattgtgggggactaaagaatgtaagagaagtcaaaggcctaacaaaaggaggaccaggacacgaagaacctatccccatgtcaacatatgggtggaatctagtgcgtcttcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaactcgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggcagagcccgcatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 698 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgttatgttgattccaacagcgatggcgttccatttaaccacacgcaatggagaaccacacatgatcgttggcaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggctaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtacagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgctaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaatcgtgaaagaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacctccattcggagacagctacatcattataggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcgctggaagttgaagactatggttttggagttttttccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaacggagtactagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccatgccagagaccattcttgaactgactgatgcgttagccttgggcatgatggtcctcaaaatagtgagaaatatggaaaaataccaattggcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagtattgaagacaatccagagatcgaagatgacattttccgaaagaaaagattgaccatcatggacctccatccaggagcaggaaagacaaaaagataccttccagccatagttagagaagccataaatcgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcacgccacatttactatgaggctgctatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagcaggaagacttttgactctgagtatgttaagactagagccaatgattgggactttgtggtcacaactgacatttcagaaatgggtgctaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacttttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacagctagcagcctcctatggtatgcacagatccaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtagctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattgaacgcactgggaaaaagtgaatttcagatctacaagaaaagtggaatccaggaagtggatagaaccctagcaaaagaaggtatcaaaagaggagaaacggaccaccatgctgtgtcacgaggatcagcaaaactgagatggttcgtcgagagaaatatggtcacaccggaagggaaggtggtggatctcggttgcggcagagggggatggtcatactattgtgggggactaaagaatgtaagagaagtcaaaggcctaacaaaaggaggaccaggacacgaagaacctatccccatgtcaacatatgggtggaatctagtgcgtctgcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaactcgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagattgctgactaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggaactggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcatctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgctcacaccattttcatgagttagtcatgaaagatggtcgcgtgctcgtagtcccatgcagaaaccaagatgaactgattggcagagcccgcatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 699 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcaggggcgaggaccattaaaactgttcatggccctggtggcgttccttcgtttcctaacaatcccaccaacagcagggatattgaagagatggggaacaatcaaaaaatcaaaagccattaatgttttgagagggttcaggaaagagattggaaggatgctgaacatcttgaataggagacgcagatctgcaggcatgatcattatgctgattccaacagtgatggcgttccatctaaccacacgtaacggagaaccacacatgatcgtcagtagacaggagaaagggaaaagtcttctgtttaaaacagaggatggcgtgaacatgtgcaccctcatggccatggaccttggcgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactagagacgcgaactgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcttaaaagaagagcaggataagaggttcgtctgcaaacactccatggtagacagaggatggggaaatggatgtggattatttggaaagggaggcattgtgacctgtgctatgttcacatgcaagaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccattacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcatcaggaaacttactcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggtttaagaaaggaagttctatcggccgaatgtttgagacaacaatgaggggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtggaatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgatctccacagagtctcataaccaaacctttctcattgatggccccgaaacagcagaatgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaactacagtggtagtgactgaggactgcggaaatagaggaccctctttgagaacaaccactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactaggagtcttgggaatggcattgttcctggaggaaatgcttaggacccgagtaggaacgaaacatgcaatactactagttgcagtttcttttgtgacattgatcacagggaacatgtcctttaaagacctaggaagagtggtggttatggtaggcgccaccatgacggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccattcttgaattgactgatgcattagccttaggcatgatggtcctcaaaatggtaagaaacatggagaagtatcagttagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccagcaagaaaaggagctggccactaaatgaggctatcatggcagtcggaatggtgagcattttagccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctacagaattaagcaaaaagggattcttggatattcccagatcggagctggagtttataaagaaggaacattccatacaatgtggcatgtcacacgtggcgctgtcctaatgcacaaaggaaagaggattgaaccatcatgggcggacgtcaaaaaagatctaatatcatatggaggaggctggaagttagaaggagaatggaaggaaggagaagaagtccaggtgctggcattggagcctggaaaaaatccaagagccgtccaaacaaaacctggtcttttcaaaaccaacgccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaacccagagatcgaagatgacattttccgaaagagaagactgaccatcatggacctccacccaggagcgggaaagacgaaaagataccttccggccatagtcagagaagctataaaacggggtttgagaacattaatcttggcccccaccagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggattttcatgacagccactcccccgggaagcagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaacgattgggatttcgtggttacaactgacatttcagaaatgggtgccaatttcaaggctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacattaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctaccaagtggcagctgaaggcatcaactatgcagacagaaggtggtgttttgatggaatcaagaacaaccaaatcctggaagaaaatgtggaagttgaaatctggacaaaagaaggggaaaggaagaaattgaaacccagatggctggatgctaggatctattctgacccactggcgctaaaagaattcaaagaatttgcagccggaagaaagtctctgaccctgaacctaatcacagaaatgggtaggcttccaacattcatgactcagaagacaagagacgcactggacaacttagcagtgctgcacacggctgaagcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgcataatcacggctagcatccttctatggtacgcacaaatacagccacattggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcatggacgctgtatgccgtggccacaacatttgttacaccaatgctgagacatagcattgagaattcctcagtgaatgtatcactaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgccttcaaagtggagttgacgttttcttcttcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaatccatatatgccctcagttatagaaaaaatggaaacactgcaaaggaaatatggaggagccttagtgagaaatccactctcacggaactccacacatgagatgtactgggtatccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccctgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgatggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtaccaaaacaaggtggtgcgtgtgcaaagaccaacaccaagaggcacagtaatggacatcatatcgagaagagaccaaagaggtagtgggcaagttggtacctatggactcaacactttcaccaatatggaagcccaattaatcagacagatggagggagaaggagtctttaaaaacattcagcacctgacagtcacagaagaaaccgccgtgcaaaactggttagcaagagtggggcgcgaaaggttatcaagaatggccatcagtggagatgattgtgttgtgaaacctttagatgacagattcgcaagcgctttgacagctctaaatgacatgggaaagattagaaaagacatacaacaatgggaaccttcaagaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacattgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagactacatgccatccatgaaaagattcagaagagaagaggaagaagcaggagtcctgtggtag

SEQ ID NO: 700 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattgaaactgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgctgattccaacagtgatggcgttccatctaaccacacgtaacggagagccacacatgatcgttagcagacaagagaaagggaaaagtctcctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtactaccacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaagcaaagctaactaacacaacaacagaatctcgttgcccaacacaaggggaacccagcctaaatgaagagcaggataagaggttcgtctgcaaacactccatggtagacagaggatggggaaatggatgtggattatttggaaagggaggcattgtgacctgtgctatgttcacatgcaaaaagaacatggaaggaaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccgttaccatggctgcccggagcagatacacaagggtcaaattggatacagaaagaaacattggtcactttcaaaaatccccatgcgaagaaacaggatgttgttgttttaggatcccaagaaggggccatgcacacagcactcacaggagccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtaaaatcccttttgagataatggatttggaaaaaagacatgtcttaggccgcctgatcacagtcaacccaattgtgacagaaaaagatagcccagtcaacatagaagcagaacctccattcggagacagctacatcatcataggagtagagccggggcaactgaagctcaactggtttaagaaaggaagttctatcggccaaatgtttgagacaacaatgaggggggcgaagaggatggccattttgggtgacacagcctgggattttggatccctgggaggagtgtttacatctataggaaaagctctccaccaagtctttggagcaatctatggagctgccttcagtggggtttcatggactatgaaaatcctaataggagtcattatcacatggataggaatgaactcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtggaatccgctcggtaacaagactggagaatctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacagcagaatgccccaacacaaatagagcttggaattcgttggaagttgaagactacggctttggagtgttcaccaccaatatatggctaaagttgaaagaaaaacaggatgcattctgcgactcaaaactcatgtcagcggccataaaagacaacagagccgtccatgccgatatgggttattggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttttgcgatggaactacagtggtagtgactgaggactgcggaaatagaggaccctctttgagaacaactactgcctctggaaaactcataacagaatggtgctgccgatcttgcacattaccaccgctaagatacagaggtgaggatgggtgctggtacgggatggaaatcagaccattgaaagagaaagaagaaaatttggtcaactccttggtcacagccggacatgggcaggttgacaacttttcactaggagtcttgggaatggcattgttcctggaggaaatgcttaggacccgagtaggaacgaaacatgcaatactactagttgcagtttcttttgtgacattgatcacagggaacatgtcctttaaagacctaggaagagtggtggttatggtaggcgccactatgacggatgacataggtatgggcgtgacttatcttgccctactagcagccttcaaagttagaccaacttttgcagctggactactcttgagaaagctgacctccaaggaattgatgatgactactataggaattgtactcctctcccaaagcaccataccagagaccattcttgaattgactgatgcgttagccttaggcatgatggtcctcaaaatggtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttaacatcctcacagcaaaaaacggattggataccattagcattgacaatcaagggtctcaatccaacagccatttttctaacaaccctctcaagaaccagcaagaaaaggagctggccattgaatgaggctatcatggcagtcggaatggtgagcattttagccagttctctcctaaaaaatgacattcccatgacaggaccactagtggctggagggcttctcactgtgtgctacgtgctcactggacgatcggccgacttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatacttattagaacaggattgctggtgatctcaggactttttcctgtatcaataccaatcacggcagcagcatggtacctgtgggaagtgaagaaacaacgggctggagtattgtgggatgttccttcacccccacccatgggaaaggctgaactggaagatggagcctatagaatcaagcaaaaagggattcttggatattcccagatcggagccggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtactggcattggagcctggaaaaaatccaagagccgtccaaacaaaacctggtcttttcaaaaccaacgccggaacaataggtgccgtatctctggacttttctcctggaacgtcaggatctccaatcattgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaaaagataccttccggccatagtcagagaagctataaaacggggtttgagaacattaatcttggcccccaccagagttgtggcagctgaaatggaggaagctcttagaggacttccaataagataccaaaccccagccatcagagctgagcacaccgggcgggaaattgtggatctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggattttcatgacagccactcccccgggaagcagagacccatttcctcagagcaatgcaccaatcatagatgaagaaagagaaatccctgaacgttcgtggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcctagtatgttcgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactacgcagacagaaggtggtgttttgatggaatcaagaacaaccaaatcttggaagaaaatgtggaagttgaaatctggacaaaagaaggggaaaggaagaaattgaaacccagatggctggatgctaggatctattctgacccactggcgctaaaagaattcaaggaatttgcagccggaagaaagtctctgaccctgaacctaatcacagaaatgggtaggcttccaacattcatgactcagaagacaagagacgcactggacaacttagcagtgctgcacacggctgaagcaggtggaagggcgtacaatcatgctctcagtgaactgccggagaccctggagacattgcttttactgacacttctggctacagtcacgggagggatctttttattcttgatgagcgggaggggcatagggaagatgaccctgggaatgtgctgcataatcacggctagcgtcctcctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcctgcatcagcatggacgctgtatgccgtggccacaacatttgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagttaaaggcctaacaaaaggaggaccaggacacgaagaacccatccccatgtcaacatatgggtggaatctagtgcgtcttcaaagtggagttgacgttttcttcatcccgccagaaaagtgtgacacattgttgtgtgacataggggagtcatcaccaagtcccacagtggaagcaggacgaacgctcagagtccttaatttagtagaaaattggttaaacaacaacactcaattttgcataaaagttctcaacccatatatgccctcagttatagaaaaaatggaaacactgcaaaggaaatatggaggagccttagtgagaaatccactctcacggaactccacacatgagatgtactgggtatccaatgcttccgggaacatagtgtcatcagtgaacatgatttcaaggatgttgatcaacagattcacaatgagacacaagaaagccacttacgagccggatgttgacctcggaagcggaacccgcaacatcggaattgaaagtgagataccaaacctagacataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactgatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagaaaagaagctaggggaatttggcaaggcaaaaggcagcagagccatatggtacatgtggcttggagctcgcttcctagagtttgaagccctaggattcctaaatgaagatcactggttctccagagagaactccctgagtggagtggaaggagaagggctacacaagctaggttacattctaagagacgtgagcaagaaagagggaggagctatgtatgccgatgacacagcaggatgggacacaagaatcacactagaagacctaaaaaatgaagaaatggtaacaaaccacatggaaggagaacacaagaaattagccgaggccattttcaaactaacgtaccaaaacaaggtggtgcgtgtgcaaagaccaacaccaagaggcacagtaatggacattatatcgagaagagaccaaagaggtagtggacaagttggtacctatggactcaatactttcaccaatatggaagcccaattaatcagacagatggagggagaaggagtctttaaaaacattcagcacctgacagtcacagaagaaatcgccgtgcaaaactggttagcaagagtggggcgcgaaaggttatcaagaatggccatcagtggagatgattgtgttgtgaaacctttagatgacaggttcgcaagcgctttgacagctctaaatgacatgggaaagattaggaaagacatacaacaatgggaaccttcaagaggatggaacgattggacacaagtgcccttctgttcacaccatttccatgagctaatcatgaaagatggtcgcgtacttgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgccatttgctcggcagtaccatcacattgggttccaacaagtcgaacaacttggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacttgggcaaagaacatccaagcagcaataaatcaagttagatcccttataggcaatgaggaatacacagattacatgccatccatgaaaagattcagaagagaagaggaagaagcaggagtcctgtggtag

SEQ ID NO: 701 - DNA, 10176 bp, Dengue virus
atgaataaccaacggaaaaaggcgaaaaacacgcctttcaatatgctgaaacgcgagagaaaccgcgtgtcgactgtgcaacagctgacgaagagattctcacttggaatgctgcagggacgaggaccattaaaactgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgtaggcatgatcattatgctgattccaacagtaatggcgttccatctgaccacacgcaacggagaaccacatatgatcgtcagtatacaagagaaagggaaaagtctcctgtttaaaacagaggatggcgtgaacatgtgcaccctcatggccatggaccttggtgaattgtgtgaagacacaatcacgtacaagtgtccccttctcagacagaatgagccagaagacatagattgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcttgctgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcaccttcaaaaatccccatgcgaagaaacaggatgttgttgttttaggatcccaagaaggggccatgcatacagcactcacaggagccacagaaatccaaatgtcgtcaggaaacttactcttcactggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgtaaagtcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagttctatcggccagatgtttgagacaacaatgaggggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtgttggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagactggagaacctaatgtggaaacagataacaccagaattgaatcacattctagcagaaaatgaggtgaagttaactattatgacaggagacatcaaaggaatcatgcaggcaggaaaacgatctctgcggcctcagcccactgagctaaagtactcatggaaaacatggggcaaagcaaaaatgctctccacagagtctcaaaaccaaacttttctcattgatggccccgaaacagcagaatgccccaacacaaatagagcttggaactcattggaggttgaagactacggttttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtggtgactgaggactgcggaaatagaggaccctctttgagaacaactactgcctctggaaaactcataacagaatggtgctgccgatcttgcacattgccacccctaagatatagaggtgaggatgggtgctggtacgggatggaaatcagaccattgaaagagaaagaagaaaatttggttaactccttggtcacagccggacaagggcaggttgacaatttttcactaggagtcttgggaatggcattgttcctggaggaaatgcttaggacccgagtaggaacgaaacatgcaatactactagttgcagtttcttttgtgacattgatcacagggaacatgtcctttaaagacctaggaagagtggtggttatggtaggggccaccatgacggatgacataggtatgggcgtaacttatcttgccctactagcagcctttaaagtcagaccaacttttgcagctggactactcttgagaaagctgacctccaaggaattgatgatgaccaccataggaattgtactcctctcccaaagcactataccagaaaccatccttgaattgactgatgcgttagccttaggcatgatggtcctcaaaatagtaagagacatggaaaagtatcaattggcagtgactatcatggctatcttgtgcgtcccaaacgcagtgatattacaaaatgcatggaaagtgagttgcacaatactagcagtggtgtccgtttccccactgcttttgacatcctcacagcaaaaaacggattggataccattagcattgacaatcaagggtctcaatccaacagccatctttctaacaactctctcaagaaccaacaagaaaaggagctggccactaaatgaggccatcatggcagtcggaatggtgagcattttagccagttctctcctaaaaaatgatatccctatgacaggaccactagtggctggagggctcctcactgtatgctacgtgctcactggacgatcggccgacttggaactggagagagcaaccgatgtcaaatgggaagaccagccagagatatcaggaaccagtccaatcctgtcaataacaatatcagaagatggtagcatgtcgataaaaaatgaagaggaagaacaaacactgaccatactcattagaacaggattgctggtgatctcaggactttttcctgtgtcaataccaatcacggcagcagcatggtacctgtgggaagtgaagaaacaacgggccggagtattgtgggatgttccttcacccccacccatgggaaaggctgaactggaagatggagcctacagaatcaagcaaaaagggattcttggatattcccagatcggagctggagtttataaagaaggaacattccatacgatgtggcatgtcacacgtggcgctgtcctaatgcataaaggaaagaggattgaaccatcatgggcggacgtcaaaaaagatctaatatcatatggaggaggctggaagctagaaggagaatggaaggaaggagaagaagtccaggtgctggcattggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggcaatggtgttgttacaaggagtggagcatatgtgagtgctatagcccaaactgaaaaaagcattgaagacaacccagacatcgaagatgacattttccgaaagagaagactgaccatcatggacctccacccaggagcgggaaagacgaaaagataccttccggccatagtcagagaagccataaaacggggtttgagaacattaatcttggcccccaccagagttgtggcagctgaaatggaggaggctctcagaggacttccaataagataccaaaccccagccatcagagctgagcacacagggcgggaaattgtggatctaatgtgtcatgccacatttaccatgaggctgctatcaccagttagagtgccaaactacaacctgattatcatggatgaagcccatttcacagacccagcaagtatagcagctagaggatacatctcaactcgagtggagatgggtgaagcagctgggattttcatgacagccactcccccgggaagcagagatccatttcctcagagcaatgcaccgatcatagatgaagaaagagaaatccctgaacgttcatggaattctggacacgagtgggttacggattttaaagggaaaactgtttggttcgttccaagcataaaagcaggaaatgatatagcagcttgcctgagaaaaaatggaaagaaagtaatacaacttagtaggaagacttttgattctgagtatgccaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacattaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggctggcctacaaagtggcagctgaaggcatcaactatgcagacagaaggtggtgttttgatggaatcaagaacaaccaaatcctggaagagaatgtggaagttgaaatttggacaaaagaaggggaaaggaagaaattgaaacccagatggctggatgctaggatctactctgacccactggcgctaaaagaattcaaagaatttgcagccggaagaaagtctctgaccctgaacctaattacagaaatgggtaggcttccaacattcatgactcagaagacaagagacgcactggacaacttagcagtgctgcacacggccgaagcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgcatagtcacggctagcatccttttatggtacgcacaaatacagccacactggatagcagcttcaataatactggagttttttctcatagttttgcttattccagaaccagaaaaacagagaacaccccaagacaaccaattaacctatgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgccccgcatcagcatggacgctgtatgccgtggctacaacatttgttacaccaatgctgagacatagtattgagaactcctcagtgaatgtatccctaacagctatagctaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccattatagggccaggacttcaagcaaaagcaactagagaagctcagaaaagagcagcggcgggcatcatgaaaaacccaaccgttgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttggctaccgggcccatctccacactgtgggaaggaaatccaggaaggttctggaacactaccattgcggtgtcaatggccaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaacaaacgtaagagaagtgaaaggcctgacaaaaggaggaccaggacacgaagaacccatccccatgtcaacatatgggtggaatctagtgcgtcttcaaagtggagttgacgttttcttcgtcccgccagaaaagtgtgacacattgttgtgtgacataggggagtcatcaccaaatcctacagtggaagcaggacgaacactcagagtccttaatttagtagaaaattggttgaacaacaacactcaattttgcataaaagttctcaacccatatatgccctcagttatagaaaaaatggaaacactgcaaaggaaatatggaggagccttagtgagaaatccactctcacggaactccacacatgagatgtactgggtatccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagcaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggctcggagctcgcttcctggagtttgaagccctaggattcctaaatgaagatcactggttctccagagagaactccttgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtaccaaaacaaggtggtgcgtgtgcaaagaccaacaccaagaggcacagtaatggacatcatatcaagaagagaccaaagaggtagtgggcaagttggtacctatggactcaatactttcaccaatatggaagcccaattaatcagacagatggagggagaaggagtttttaaaaacattcagcacctgacagtcacagaagaaatcgccgtgcagaactggttagcgagagtggggcgcgaaaggttatcaagaatggccatcagtggagatgattgtgttgtgaaacctttagatgacaggttcgcgagcgctttgacagctctaaatgacatgggaaagattagaaaagacatacaacaatgggaaccttcaagaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggttggcggcaaatgccatttgctcggcagtgccatcacattgggttccaacaagtcgaacaacctggtccatacacgccaaacatgaatggatgacaacggaagacatgctgacagtctggaatagggtgtggattcaagaaaacccatggatggaagacaaaaccccagtggaatcatgggaggaaatcccgtacttggggaaaagagaagaccaatggtgtggctcactgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 702 - DNA, 10176 bp, Dengue virus
atgaataaccaacggaaaaaggcgagaagtacgcctttcaatatgctgaaacgcgagagaaaccgcgtgtcgactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgattaaaaaatcaaaagctatcaatgttttgagagggttcagaaaagagattggaagaatgctgaacatcttgaacaggagacgcaggacagcaggcgtgattgttatgttgattccaacagcgatggcgttccatttaaccacacgtgatggagaaccacacatgatcgttggtagacaagagaaagggaaaagtcttctgttcaaaacagaggatggtgtgaacatgtgtaccctcatggccatagatcttggtgaattgtgtgaagatacaatcacgtacaagtgccccctcctcaggcagaatgaaccagaagacatagattgctggtgtaactctacgtccacatgggtaacttatgggacgtgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacacccaggctttaccataatggcagcaatcctggcatacaccataggaacgacacatttccaaaaggccctgattttcatcttactgacagctgtcgctccttcaatgacaatgcgttgcataggaatatcaaatagagactttgtagaaggggtttcaggaggaagctgggttgacatagtcttagagcatggaagttgtgtgacgacgatggcaaaaaacaaaccaacattggattttgaactgataaaaacagaagccaaacaacctgccaccctaaggaaatactgcatagaagcaaagctgaccaatacaacaacagaatctcgttgcccaacacaaggggaacccagtctaaaagaagagcaggacaaaagattcgtctgcaaacactccatagtagacaggggatggggaaatggatgtggattatttggaaaggggggcattgtgacctgtgctatgtttacatgcaaaaagaacatggaaggaaaaatcgtgcaaccagaaaatttggaatacaccatcgtgataacacctcactcaggggaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgcctttaccatggctacccggagcggacacacaaggatcaaattggatacagaaagagacgttggtcacctttaaaaatccccacgcaaagaaacaggatgtcgttgttttaggatctcaagaaggggccatgcacacggcactcacaggggccacagaaatccagatgtcatcaggaaacttactattcacaggacatctcaagtgcaggctgagaatggacaaactacagctcaaaggaatgtcatactctatgtgtacaggaaagtttaaaattgtgaaggaaatagcagaaacacaacacggaacaatagttatcagagtacaatatgaaggggacggctctccatgtaagatcccttttgagataatggatttggaaaaaagacatgtcttaggtcgtctgattacagttaacccgatcgtaacagaaaaagatagcccagtcaacatagaagcagaacctccattcggagacagctacatcatcataggagtagagccgggacaattgaaactcaactggtttaagaaaggaagttccatcggccaaatgtttgagacaacaatgagaggagcgaagagaatggccattttaggtgacacagcctgggattttggatccctgggaggagtgtttacatctataggaaaggctcttcaccaagttttcggagcaatctatggggctgcctttagtggggtctcatggactatgaaaatcctcataggagtcatcatcacatggataggaatgaattcacgtagcacctcactgtctgtgtcactagtattggtgggagtcgtaacactgtacttgggagctatggtgcaggctgatagtggttgcgttgtgagctggaagaacaaagaactgaaatgtggcagcgggatctttgtcacagatagcgtgcacacatggacagaacaatataagttccaaccagaatccccttcaaaactagcttcagctatccaaaaagctcatgaagagggcatttgtggaatccgctcagtaacaagattggagaatttgatgtggaaacaaataacaccagaattgaatcatattctatcagaaaatgaggtaaagttgaccattatgacaggagacattaaaggaatcatgcaggtagggaaacgatctctgcggccccagcccactgagctgaagtattcatggaaaacatggggaaaggcgaaaatgctctccacagagtctcacaaccagacctttctcattgatggccctgaaacagcagaatgccccaacacaaacagagcttggaactcgctggaagttgaagactatggttttggagttttcaccaccaacatatggctaaaattgagagaaaaacaggatgtattttgtgactcaaaactcatgtcagcagccataaaagacaacagagccgtccatgccgatatgggttattggatagaaagtgcactcaatgacacatggaagatggagaaagcctctttcattgaagttaaaagctgccactggccaaagtcacacaccctctggagtaatggagtattagaaagtgagatgataattccaaaaaattttgctgggccagtgtcacaacacaactacagaccaggctattatacacaaacagcaggaccttggcatctaggtaagcttgagatggactttgatttctgcgaaggaactacagtggtggtgactgaggactgcggaaatagaggaccctctttaagaacgaccactgcctctggaaaactcataacagaatggtgctgccgatcctgcacattaccacctctaagatacagaggtgaggatggatgctggtacgggatggaaatcagaccattgaaagagaaagaagagaatttggtcaactccttggtcacagccggacatgggcagattgacaacttttcactaggaatcttggggatggcactattcctggaagaaatgctcaggacacgagtaggaacgaaacatgcaatactgctagttacagtttctttcgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactactgagaaagctgacctccaaggaattgatgatggctaccataggaatcgcactcctttcccaaagcaccataccagagaccattcttgaactgactgatgcgttagccttgggcatgatggtccttaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaggctatcatggcagtcgggatggtgagcattttagccagttctctcttaaagaatgacattcctatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggactctttccagtatcaataccactcacggcagcagcatggtacctgtgggaagtgaagaaacaacgggctggagtactgtgggacgtcccgtcacccccacccgtgggaaaggccgaactggaagatggagcctatagaatcaagcaaaaagggattcttggatattctcagattggagccggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaagtccaagtcctggctttggaaccaggaaaaaatccaagagccgtccaaacgaaacctggacttttcaaaaccaacaccggaaccataggcgccgtatctctggacttttctcctggaacgtcaggatctccaattgtcgacagaaaaggaaaagttgtgggtctttatggcaatggtgttgtcacaaggagtggagcatacgtgagtgccatagcccagaccgaaaaaagcattgaagacaatccagagatcgaagatgatattttccggaagaaaagattgaccatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagctgagcacaccgggcgggagattgtggacctgatgtgtcatgccacatttactatgaggctgctatcaccagtcagagtgccaaattacaacctaatcatcatggatgaagcccacttcacagacccagcaagtatagcagctagaggatatatttcaactcgagtagagatgggtgaagcagctgggattttcatgacagccactcctccaggaagtagagacccatttcctcagagcaatgcaccaatcatggatgaggaaagagaaatccctgagcgttcgtggaattctggatatgaatgggtcacggattttaaagggaagactgtctggttcgttccaagtataaaagcgggaaatgacatagcagcttgtctcagaaaaaatggaaagaaagtgatacaactcagtaggaagacctttgactctgagtatgttaaaactagaaccaatgattgggactttgtggttacaactgacatttcagaaatgggtgctaacttcaaggctgagagggttatagaccccagacgttgcatgaaaccagttatactaacagatggcgaagagcgggtgatcctggcaggacctatgccagtaacccactctagtgcagcgcaaagaagagggagaataggaagaaatccaaaaaatgaaaatgaccagtacatatacatgggggaacctctggaaaatgacgaagactgcgcacattggaaagaagccaaaatgctcctagataacatcaacacaccagaaggaatcattcctagtatgtttgaaccagagcgtgaaaaggtggatgccattgatggtgaataccgcttgagaggagaagcaaggaaaacctttgtggacttaatgagaagaggggacttaccagtctggctggcttacagagtggcagctgaaggcatcagctacgcagacagaaggtggtgctttgatggaattaagaacaaccaaatactggaagaaaacgtggaagtggaaatctggacaaaagaaggagaaaggaagaaattaaaacccagatggttggatgctaggatctattctgacccactggcactaaaagaattcaaggaatttgcagctggaagaaagtccttgaccctgaacctaatcacagaaatgggtaggcttccaactttcatgactcagaaggcaagagacgcactggataacctagctgtgctgcacacggctgaggcaggtggaagggcgtacaaccatgctcttagtgaactgccggagaccctagagacattgcttttactgacactcctggccacagtcacgggaggaatcttcttattcttaatgagcggaaagggtatagggaagatgaccctgggaatgtgttgcataatcacggctagtatcctcctatggtatgcacagatacaaccacactggatagcagcctcaataatattggagttttttctcatagttttgctcattccagaaccagaaaaacagagaacacctcaagataaccaattgacctacgttgtcatagccatcctcacagtggtggccgcaaccatggcaaacgagatgggtttcctggaaaaaaccaagaaagacctcggatttggaagcattgcaacccaggaacctgagagcaacatcctggacatagatctacgtcctgcgtcagcatggacgctgtacgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttcctctccttgccattggatgctactcacaagtcaaccctataacccttacagcagctcttcttttattggtagcacattatgccattatagggccaggacttcaagcgaaagcaaccagagaagctcagaaaagagcagcagcaggcatcatgaaaaacccaacagtcgatggaataacagtgattgacctagatccaataccctatgatccaaaatttgaaaaacagttaggacaagtaatgctcctaatcctctgcgtgactcaagtattgatgatgaggaccacatgggctctgtgtgaggctctaaccttagctaccgggcccatctccacattgtgggaaggtaatccagggaggttttggaacaccaccattgcagtgtcaatggctaatatttttagagggagctacttggccggagctggacttctcttttccatcatgaagaatacaacaagcacaagaagagggactggcaacataggagagacgcttggagagaaatggaaaagccgattgaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaagtggtggacctcggttgtggcagagggggctggtcatactattgtgggggactaaagaatgtaagagaagtcaaaggcctgacaaaaggaggaccaggacacgaagaacccattcccatgtcaacatatgggtggaatctagtgcgtctgcagagtggagttgacgttttcttcactccgccagaaaagtgtgatacattgttgtgtgacataggggagtcgtcaccaaatcccacgatagaagcaggacgaacactcagagttctcagcttagtagaaaattggttgaacaataacacccaattttgcataaaggttctcaacccatatatgccctcagtcatagaaaaaatggaaacactacaaaggaaatatggaggagctttagtgaggaatccactctcacgaaactccacacatgagatgtactgggtatccaatgctaccgggaacatagtgtcatcagtgaatatgatttcaaggatgttgattaacagattcacaatgaaacacaagaaagccacctacgagccagatgttgacctaggaagcggaacccgtaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacagactggatcagcatcatccatggtgaacggagtggtcagactgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaatcacggcagagtggctttggaaagaactaggaaagaaaaagacacccaggatgtgtaccagagaagaattcacaagaaaggtgagaagcaatgcagccttgggggccatattcactgatgagaacaaatggaagtcggcacgcgaggctgttgaagatagtaggttttgggagctggttgacaaggaaagaaatctccatcttgaaggaaagtgtgaaacatgtgtgtacaacatgatgggaaagagagaaaagaaactaggggagtttggcaaggcaaaaggcagcagagccatatggtacatgtggcttggagcacgctttttggagtttgaggccctaggattcttgaatgaagatcactggttctccagagagaattccctgagtggagtggaaggagaagggctgcacaagctaggctacattttaagagacgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatatttaaactaacgtaccaaaacaaggtggtgcgtgtgcaaagaccaacaccaagaggcacagtaatggacatcatatcgagaagagaccaaagaggcagtgggcaagtcggcacctatggccttaacactttcaccaatatggaagcccaattaattagacagatggagggagaaggaatcttcaaaagcattcagcatctgacagtcacagaagaaatcgctgtacagagctggttagcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccctcaagaggatggaacgattggacacaagtgcctttctgttcacaccattttcatgagttaatcatgaaagacggtcgcgtgctcgtagttccatgcagaaaccaagatgaactgattggcagagcccgaatttcccagggagctgggtggtctctgaaagagacggcctgtttggggaagtcttacgcccaaatgtggagcctgatgtacttccacagacgtgacctcaggctggcggcaaatgctatttgctcggcggtcccgtcacattgggttccaacaagtcgaacaacctggtctatacacgccaaacatgaatggatgacgacggaagacatgctgacagtctggaacagggtgtggatccaagaaaacccatggatggaagacaaaactccagtggagtcatgggaggaagtcccatacctgggaaaaagagaagaccaatggtgcggctcattgattgggctaacaagcagggctacctgggcaaagaacatccaaacagcaataaatcaagtcagatccctcataggcaatgaggaatacacagattacatgccatccatgaagagattcagaagggaagaggaagaggcaggtgtcctgtggtag

SEQ ID NO: 703 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgttgcagggacgaggaccgttaaaactgttcatggccctggtgacgttccttcgtttcctaacaatcccaccaacagcagggatattgaagagatggggaacaattaaaaaatcaaaagccatcaatgttttgagaggattcaggaaagagattggaaggatgctgaacatcttgaataggagacgcagatctgcaggcatgatcattatgctgattccaacagtgatggcgttccatctaaccacacgtaacggagaaccacacatgatcgtcagtagacaagagaaagggaaaagtcttctgtttaaaacagaggatggcgtgaacatgtgcaccctcatggccatggaccttggtgaactgtgtgaagacacaatcacttacaagtgtccctttctcaggcagaatgagccagaagacatagactgctggtgcaactccacgtccacgtgggtaacctatgggacttgtaccaccacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggctttaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaagcaaagttaactaacacaacaacagaatctcgttgcccaacacaaggggaacccagcctaaatgaagagcaggataagaggttcgtctgcaaacactccatggtagacagaggatggggaaatggatgtggattatttggaaagggaggcattgtgacctgtgctatgttcacatgcaaaaagaacatggaaggaaaaatcgtgcaaccagaaaacttggaatacaccattgtggttacacctcactcaggggaagagcatgcggtcggaaatgacacaggaaaacatggtaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccgttaccatggctgcccggagcggacacacaagggtcaaattggatacagaaagaaacattggtcactttcaaaaatccccatgcgaagaaacaggatgttgttgttttaggatcccaagaaggggccatgcacacagcactcacaggagccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggtcgcctgatcacagtcaacccaattgtgacagaaaaagatagcccagtcaacatagaagcagaacctccatttggagacagctatatcatcataggagtagagccgggacaactgaagctcaactggtttaagaaaggaagttctatcggccaaatgtttgagacaacaatgaggggggcgaagagaatggccattttgggtgacacagcctgggattttggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtggaatccgctcagtaacaagactggagaatctgatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacagcagaatgccccaacacaaatagagcctggaattcgttggaagttgaagactacggctttggagtgttcaccaccaatatatggctaaaattgaaagaaaaacaggatgcattctgcgactcaaaactcatgtcagcggccgtaaaagacaacagagccatccatgccgatatgggttattggatagaaagtgcactcaatgacacatggaagatagagaaagcctctttcattgaagtaaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaactacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaagagaaagaagaaaatttggttaactccttggtcacagccggacatgggcaggttgacaacttttcactaggagtcttgggaatggcattgttcctggaggaaatgcttaggacccgagtgggaacgaaacatgcaatactactagttgcagtttcttttgtgacattgatcacagggaacatgtcctttaaagacctaggaagagtggtggttatggtaggcgccactatgacggatgacataggtatgggcgtgacttatcttgccctactagcagccttcaaagttagaccaacttttgcagctggactactcttgagaaagctgacctccaaggaattgatgatgactactataggaattgtactcctctcccaaagcaccattccagagaccattcttgaattgactgatgcgttagccttaggcatgatggtcctcaaaatggtaagaaacatggaaaagtatcaattagcagtgactatcatggctatcttgtgcgtcccaaacgcagtgatattacaaaatgcatggaaagtgagttgcacaatactggcagtggtgtccgtttccccgctgcttttaacatcctcacagcaaaaaacggattggataccattagcattgacaatcaagggtctcaatccaacagccatttttctaacaaccctctcaagaaccagcaagaaaaggagctggccattaaatgaggctatcatggcagtcggaatggtgagcattttagccagttctctcctaaaaaatgatattcccatgacaggaccactagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaatcaagcaaaaaggaattcttggatattcccagatcggagccggagtttataaagaaggaacattccatacaatgtggcatgtcacacgtggcgctgtcctaatgcataaaggaaagaggattgaaccatcatgggcggacgtcaagaaagacctaatatcatatggaggaggctggaagttagaaggagaatggaaggaaggagaagaggttcaggtactggcattggagcctgggaaaaatccaagagctgtccaaacaaaacctggtctttttaaaaccaacgccggaacaataggtgccgtgtctctggacttttctcctggaacgtcaggatctccaatcattgacaaaaaaggaaaagttgtgggtctttatggtaatggtgttgttacaaggagtggagcatatgtgagtgctatagcccagactgaaaagagcattgaagacaacccagagatcgaagatgacattttccgaaagagaagactgaccatcatggacctccacccaggagcgggaaagacgaagagataccttccggccatagttagagaagctataaaacggggtttgagaacattaatcttggcccccaccagagttgtggcagctgaaatggaggaagctcttagaggacttccaataagataccaaaccccagccatcagagctgagcacaccgggcgggaaattgtggatctaatgtgtcatgccacatttaccatgaggctgctatcaccagttagggttccaaactacaacctgattatcatggacgaagcccatttcacagacccagcaagtatagcagccagaggatacatctcaactcgagtggagatgggtgaggcagctgggattttcatgacagccactcccccgggaagtagagacccatttcctcagagcaatgcaccaatcatagatgaagaaagagaaatccctgaacgttcgtggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgctaatttcaaggctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcctagcatgttcgaaccagagcgtgaaaaagtggatgccattgatggcgaataccgcttgagaggagaagcaaggaaaacctttgtagacttaatgagaagaggagacctaccagtctggttggcctacaaagtggcagctgaaggcatcaactacgcagacagaagatggtgttttgatggaatcaagaacaaccaaatcttggaagaaaatgtggaagttgaaatctggacaaaagaaggggaaaggaagaaattgaaacccagatggctggatgctaggatctattctgacccactggcgctaaaagaattcaaggaatttgcagccggaagaaagtctttgaccctgaacctaatcacagaaatgggtaggcttccaacattcatgactcagaagacaagagacgcactggacaacttagcagtgctgcacacggctgaagcaggtggaagggcgtacaatcatgctctcagtgaactgccggagaccctggagacattgctcttactgacacttctggctacagtcacgggagggatctttttattcctgatgagcgggaggggcatagggaagatgaccctgggaatgtgttgcataatcacggctagcatcctcctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcctgcatcagcatggacgctgtatgccgtggccacaacatttgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaggcaaaagcaaccagagaagctcaaaaaagagcagcggcgggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggctttgaccttagctaccgggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggacagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagttaaaggcctaacaaaaggaggaccaggacacgaggaacccatccccatgtcaacatatgggtggaatctagtgcgtcttcaaagtggagtcgacgttttcttcatcccgccagaaaagtgtgacacattgttgtgtgacataggggagtcatcaccaaatcccacagtggaagcaggacgaacactcagagtccttaatttagtagaaaattggttgaacaataacactcaattctgcataaaagtcctcaacccatatatgccctcagtcatagaaaaaatggaaacactgcaaaggaaatatggaggagccttagtgaggaatccactctcacggaactccacacatgagatgtattgggtatccaatgcttccgggaacatagtgtcatcagtgaacatgatttcaaggatgttgatcaacagattcacaatgagacacaagaaagccacttacgagccggatgttgacctcggaagcggaacccgtaacatcgggattgaaagtgagataccaaacctagacataatcggaaaaagaatagaaaaaataaagcaagagcatgaaacatcatggcactatgaccaggatcacccatacaaaacgtgggcataccatggtagctatgaaacaaaacagactggatcagcatcatccatggtcaacggagtggtcaggctgctgacaaaaccttgggacgtcatccccacggtgacacagatggcaatgacagacacgactccatttggacaacagcgtgtctttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagcaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctagagtttgaagccctaggattcctaaatgaagatcattggttctccagagagaactccctgagtggagtggaaggagaagggctgcacaagctaggttacattctaagagacgtgagcaagaaagagggaggagctatgtatgccgatgacacagcaggatgggacacaagaatcacactagaagacctaaaaaatgaagaaatggtaacaaaccacatggaaggagaacacaagaaattagccgaggccattttcaaactaacgtaccaaaacaaggtggtgcgtgtgcaaagaccaacaccaagaggcacagtaatggacattatatcgagaagagaccaaagaggtagtggacaagttggtacctatggactcaacactttcaccaatatggaagcccaattaattagacagatggagggagaaggagtttttaaaaacattcagcacctgacagtcacagaagaaaccgccgtgcaaaactggttagcaagagtggggcgcgaaaggttatcaagaatggccatcagtggagatgattgtgttgtgaaacctttagatgacaggttcgcaagcgctttgacagctctaaatgatatgggaaagattaggaaagacatacaacaatgggaaccttcaagaggatggaacgattggacacaagtacccttctgttcacaccatttccatgagctaatcatgaaagatggtcgcgtacttgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgccatttgctcggcagtaccatcacattgggttccaacaagtcgaacaacctggtccatacacgccaaacatgaatggatgacaacggaagacatgctgacagtctggaacagggtgtggattcaagaaaacccatggatggaagacaaaaccccagtggaatcatgggatgaaatcccatatttggggaaaagagaagaccaatggtgcggctcattgattgggttaacaagcagggccacttgggcaaagaacatccaagcagcaataaatcaagttagatcccttataggcaatgaggaatacacagattacatgccatccatgaaaagattcagaagagaagaagaagaagcaggagtcctgtggtag

SEQ ID NO: 704 - DNA, 10176 bp, Dengue virus
atgaataaccaacggaaaaaggcgaaaaacgcgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagccatcaatgttttgagagggttcaggaaagaaattggaaggatgctgaacatcttgaataggagacgcagatctgcaggcatgatcattatgctgattccaacagtgatggcgttccatctaaccacacgtaacggagaaccacacatgatcgtcagtatgcaagagaaagggaaaagtcttctgtttaaaacagaggatggcgtgaacatgtgcaccctcatggccatggacctaggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaagcatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaacagagattttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgtaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcttagacctgccattaccatggctgcccggagcggatacacaagggtcaaattggatacagaaagaaacattggtcactttcaaaaatccccacgcgaagaaacaggatgttgttgtcttaggatcccaagaaggggccatgcacacagcactcacaggagctacagaaatccaaatgtcgtcaggaaacttgctcttcaccggacatctcaagtgcaggctgagaatggacaagctacagctcaaaggaatgtcatactctatgtgcacaggaaagttcaaagttgtgaaggaaatagcagaaacacaacatggaacgatagttatcagagtgcaatatgaaggggacggctctccatgtaaaattccttttgagataatggatttggaaaaaagatatgtcttaggccgcctgatcacagtcaacccaattgtgacagaaaaagatagcccagtcaacatagaagcagaacctccatttggagatagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtttttggagcaatctatggagctgccttcagtggggtttcatggactatgaaaatcctcataggagtcattatcacatggataggaatgaactcacgcagcacctcactgtctgtgtcgctagtattggtgggaattgtgacactgtatttgggagtcatggtgcaggctgatagtggttgcgttgtgagctggaaaaacaaagaactgaaatgtggcagtgggattttcatcacagacaacgtgcacacatggacagaacaatacaagttccaaccagaatccccttcaaagctagcttcagctatccagaaagctcaagaagagggaatttgtgggatccgctcagtaacaagattggagaacctaatgtggaaacaaataacaccagaattgaatcacatcctagcagaaaatgaggtgaagttaactatcatgacaggagacatcaaaggaatcatgcaggcaggaaaacgatctctgcggcctcagcccactgagctaaaatactcatggaaaacatggggcaaagcaaaaatgctctccacagagtctcataaccaaacctttctcattgatggccccgaaacggcagaatgccccaacacaaacagagcttggaactcgttggaggttgaagactatggctttggagtgttcaccactaatatatggctaaaattgaaagaaaaacaggatgcattctgtgactcaaaactcatgtcagcggccataaaagacaacagagccgttcatgccgacatgggttactggatagaaagtgcactcaatgacacatggaagatagagaaagcctctttcattgaagtaaaaaactgccactggccaaagtcacacaccctctggagcaatggagtgctagaaagtgagatgataattccaaagaatcttgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaaccactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttctttcgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactactcttgagaaagctgacctccaaggaattgatgatgaccaccataggaattgtactcctctcccaaagcactataccagagaccattcttgaattgactgatgcgttagccttaggcatgatggtccttaaaatagtaagaaagatggaaaagtatcaattagcagtgactatcatggctatcttgtgcgtcccaaacgcagtgatattacaaaatgcatggaaagtgagctgcacaatactggcagcggtgtccgtttccccactgcttttgacatcctcacagcagaaaacggattggataccattagcactgacaatcaagggtctcaatccaacagccatttttctaacaaccctctcaagaaccaacaagaaaaggagctggccactaaatgaggctatcatggcagtcggaatggtgagcattttagccagttctctcctaaaaaatgatatccccatgacaggaccactagtggctggagggctcctcactgtatgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggacgttccttcacctccgcccatgggaaaggctgaactggaagatggagcttacagaatcaagcaaaaagggattcttggatattcccagatcggagctggagtttataaagaaggaacattccatacaatgtggcatgtcacacgtggcgctgtcctaatgcataaagggaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaataccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagattgaagatgacattttccgaaagagaagactgaccatcatggacctccacccaggagcgggaaagacgaaaagataccttccggccatagtcagagaagctataaaacggggtttgagaacattaatcttggcccccaccagagttgtggcagctgaaatggaggaagctctcagaggacttccaataagataccaaaccccagccatcagagctgagcacactgggcgggaaattgtggatctaatgtgtcatgccacattcaccatgaggctgttatcaccagttagagtgccaaactacaacctgattatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgacatagcagcttgcctgagaaaaaatggaaagaaagtaatacaacttagtaggaagacttttgattctgagtacgtcaagactagaaccaatgattgggatttcgtggttacaactgacatttcagaaatgggtgccaatttcaaagctgagagggttatagaccccagacgctgcatgaaaccagtcatactaactgatggtgaagagcgggtgattctggcaggacctatgccagtgacccactctagtgcagcacaaagaagagggagaataggaagaaatccaaaaaatgaaaatgaccagtacatatatatgggggaacctctggaaaatgatgaagactgtgcacactggaaagaagccaaaatgctcctagataacattaatacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgtttcgatggaattaagaacaaccaaatcctggaagaaaatgtggaagttgagatctggacaaaagaaggggaaaggaagaaattgaaacccagatggctggatgctaggatctattctgacccactggcgctaaaagaattcaaagaatttgcagccggaagaaagtctctggccctgaacctaatcacagaaatgggtaggcttccaacattcatgactcagaagacaagagacgcactggacaacttagcagtgctgcacacggctgaagcaggtgggagggcgtacaatcatgctctcagtgaactgccggagaccctagagacactgcttttactgacacttctggctacagtcacaggagggatctttttatttttgatgagcgggagaggcatagggaagatgaccctgggaatgtgctgcataattacggctagcatccttctatggtatgcacaaatacagccacactggatagcggcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagtattgcaacccaccaacccgagagcaacatcctggacatagatctacgtcccgcatcagcttggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaactagagaagctcagaaaagagcagcggcgggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccctagctaccgggcccatctccacactgtgggaaggaaatccaggaaggttctggaacaccaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaattgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcagagtggagtcgacgttttcttcatcccgccggaaaagtgtgacacattgttgtgtgacataggggagtcatcaccaaatcccacagtggaagcaggacgaacactcagagtccttaatttagtagaaaattggctgaacaacaacactcaattttgcataaaagttctcaacccatatatgccctcagttatagaaaaaatggaagcactgcaaaggaaatacggaggagccttagtgagaaatccactctcaaggaactccacacatgagatgtactgggtatccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcattacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaggtggacacgagaacccaagagccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctgggggaattcggcaaggcaaaaggcagcagagccatatggtacatgtggcttggagcccgcttcctggagtttgaagccctaggattcctaaatgaagatcactggttctccagagagaactccctgagcggagtggaaggagaagggctgcacaagctaggttacattctaagagacgtgagtaaaaaagagggaggagccatgtatgccgatgacacagcaggatgggacacaagaatcacactagaagacctaaaaaatgaagaaatggtaacaaaccacatggaaggagaacacaagaaattagccgaggccattttcagactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagctcaattaatcagacagatggagggagaaggagtctttaaaaacattcagcacctgacagtcacagaagaaattgccgtgcaaaactggttagcaagagtggggcgcgaaaggttatcaagaatggccatcagtggagatgattgtgttgtgaaacctttagatgacaggttcgcaagcgccttgacagctctaaacgacatgggaaagattagaaaagacatacaacaatgggaaccttcaagaggatggaacgattggacacaagtgcccttctgttcacaccatttccatgagctaattatgaaggatggtcgagtacttgttgttccatgtagaaaccaagatgaactgattggcagagcccgaatctcccaaggagcagggtggtctctgcgggagacagcctgtttagggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagtcagatctcttataggcaatgaggaatacacagattacatgccatccatgaaaagattcagaagagaagaggaagaagcaggagtcctgtggtag

SEQ ID NO: 705 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagccattaacgttttgagagggttcaggaaagagattggaaggatgctgaacatcttgaataggagacgcagatctgcaggcatgatcattatgctgattccaacagtgatggcgttccatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcacttgttccacatgtgggaatgggactggagacgcgaaccgaaacatggatgtcatcagaaggggcttggaaacatgcccagagaattgaaacttggatcctgagacatccaggcttcaccataatggcagcaatcctggcatacactatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaagcagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttactcttcactggacatctcaagtgcaggctgagaatggataagctacagctcaaaggaatgtcatactctatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagttctatcggccaaatgtttgagacaacaatgaggggggcgaagagaatggccattttgggtgacacagcctgggattttggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacagcagaatgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgttcatgccgacatgggttattggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtcccaacacaactatagaccaggctaccatactcaaatagcaggaccatggcatctaggtaagcttgagatggactttgatttctgcgatggaaccacagtggtagtgactgaagactgcggaaatagaggaccctctttgaggacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaacttttcactaggagtcttgggaatggcattgttcctggaggaaatgcttaggacccgagtaggaacgaaacatgcaatactactagttgcagtttcttttgtgacattgatcacagggaacatgtcctttaaagacctaggaagagtggtggttatggtaggcgccaccatgacggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaaggagctggccactaaatgaggctatcatggcagtcggaatggtgagcattttagccagttctctcctaaaaaatgatattcccatgacaggaccactagtggctggagggctcctcactgtttgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattatgggatgttccttcacccccacccatgggaaaggctgaactggaagatggagcctatagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagctagaaggagaatggaaggaaggagaagaagtccaggtgctggcattggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaacccagagatcgaagatgacattttccgaaagagaagactgaccatcatggacctccacccaggagcgggaaagacgaaaagataccttccggccatagtcagagaagctataaaacggggtttgagaacattaatcttggcccccaccagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggattttcatgacagccacccccccgggaagcagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtagaaagacttttgattctgagtatgtcaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccgttgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaatcaagaacaaccaaatcctggaagaaaatgtggaagttgaaatctggacaaaagaaggggaaaggaagaaattgaaacccagatggctggatgctaggatctattctgacccactggcgctaaaagaattcaaagaatttgcagccggaagaaagtctctgaccctgaacctaatcacagaaatgggtaggcttccaacattcatgactcagaagacaagagacgcactggacaacttagcagtgctgcacacggctgaagcaggtggaagagcgtacaatcatgctctcagtgaactgccggagaccctggagacactgcttttactgacacttctggctacagtcacgggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaactgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcatggacgctgtatgccgtggccacaacatttgttacaccaatgctgagacatagcattgagaattcctcagtgaatgtatccctaacagctatagccaaccaagcaacagtgttaatgggtctagggaaaggatggccattgtcaaagatggacattggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggcatcatgaaaaacccaaccgtcgatggaataacagtgattgatctagatccaataccttatgatccaaagtttgaaaagcagctgggacaagtaatgctcctagtcctctgcgtgactcaagtgttgatgatgaggactacatgggctctgtgtgaggccttaaccttagctaccgggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggatgtggcagaggaggctggtcatactattgtggaggactaaaaaacgtaagagaagtgaaaggcctaacaaaaggaggaccaggacacgaagaacccatccccatgtcaacatatgggtggaatcttgtgcgtcttcaaagtggagttgacgttttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaaacactgcaaaggaaatatggaggagccttagtgagaaatccactctcacggaactccacacatgagatgtactgggtatccaatgcttccgggaacatagtgtcatcagtgaacatgatttcaaggatgttgatcaacagattcacaatgagacacaagaaagccacttacgagccggatgttgatctcggaagcggaacccgcaacattggaattgaaagtgagacaccaaacctagacataattgggaaaagaatagaaaaaataaagcaagagcatgaaacatcatggcaccacgaccaagaccacccatacaaaacgtgggcatatcatggtagctatgaaacaaaacagactggatcagcatcatccatggtcaacggagtggtcaggctgctgacaaaaccttgggacgtcatccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacaccaaggatgtgcaccagagaagaattcacaagaaaggtgagaagcaatgcagccttgggggccatattcactgatgaaaacaagtggaagtcggcacgtgaggctgttgaagatagtaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtaccaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtcttcaaaaacattcagcacctgacagtcacagaagaaatcgccgtgcaaaactggttagcaagagtggggcgcgaaaggttatcaagaatggccatcagtggagatgattgtgttgtgaaacctttagatgacaggttcgcaagcgctttgacagctctaaatgacatgggaaagattagaaaagacatacaacaatgggaaccttcaagaggatggaacgattggacacaagtgcccttctgttcacaccatttccatgagctaatcatgaaggatggtcgtgtacttgttgttccatgtagaaatcaagatgaactgattggcagagcccgaatctcccaaggagcagggtggtctttgcgggagacggcttgtttggggaagtcttacgcccaaatgtggagcttaatgtatttccacagacgcgacctcaggctggcggcaaatgccatttgctcggcagtgccatcacattgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 706 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgttgattccaacagtgatggcgttccatctaaccacacgtaacggagaaccacacatgatcgtcagtagacaagagaaagggaaaagtcttctgtttaaaacagaggatggtgtgaacatgtgcaccctcatggccatggaccttggtgaattgtgtgaagacacaatcacgtacaagtgtccccttctcaggcagaatgagccagaagacatagactgttggtgcaactccacgtccacatgggtaacttatgggacttgtactaccacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcagcaatcctggcatataccatagggacgacacatttccagagagccctgattttcatcttactgacagctgtcgctccttcaatgacaatgcgttgcataggaatatcaaatagagactttgtagaaggggtttcaggaggaagctgggttgacatagtcttagaacatggaagctgcgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggattgtttgggaagggaggcattgtgacctgtgctatgtttacatgcaaaaagaacatggaaggaaaagttgtgcaaccagaaaacttggaatacaccattgtggtaacacctcactcaggggaagagcatgcggtcggaaatgacacaggaaaacatggcaaggaaatcaaagtaacaccgcagagttccatcacagaagcagaattgacaggctatggcactgtcacgatggagtgctctccgagaacaggcctcgacttcaatgagatggtgttgctgcagatggaaaacaaagcttggctggtgcacaggcaatggttcctagacctgccgttaccatggctgcccggagcggatacacaagggtcaaattggatacagaaagaaacattggtcactttcaaaaatccccatgcgaagaaacaggatgttgttgttttaggatcccaagaaggggccatgcacacagcactcacaggggccacagaaatccaaatgtcatcaggaaatttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgtaaaatcccttttgagataatggatttggaaaaaagacatgtcttaggtcgcctgatcacagtcaacccaattgtgacagaaaaagatagcccagtcaacatagaagcagaacctccattcggagacagctacatcatcataggagtagacccgggacaactgaagctcaactggtttaagaaaggaagttctatcggccaaatgtttgagacaacaatgaggggggcgaagagaatggccattttgggtgacacagcctgggattttggatccctgggaggagtgtttacatctataggaaaagctctccaccaagtctttggagcaatctatggagccgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtggaatccgctcagtaacaagactggagaatctgatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacagcagaatgccccaacacaaatagagcttggaattcgttggaagttgaagactacggctttggagtattcaccaccaatatatggctaaaattgaaagaaaaacaggatgcattctgcgactcaaaactcatgtcagcggccataaaagacaatagagccgtccatgccgatatgggttattggatagaaagtgcactcaatgacacatggaagatagagaaagcctctttcattgaagttaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaactacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaagagaaagaagaaaatttggttaactccttggtcacagccggacatgggcaggttgacaacttttcactaggagtcttgggaatggcattgttcctggaggaaatgcttaggacccgagtaggaacgaaacatgcaatactactagttgcagtttcttttgtgacattgatcacagggaacatgtcctttagagacctagggagagtggtggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccaaagcaccataccagagaccattcttgaattgactgatgcgttagccttgggcatgatggtcctcaaaatggtaagaaatatggaaaagtatcaattagcagtgactatcatggctatcttgtgcgtcccaaacgcagtgatattacaaaacgcatggaaagtgagttgcacaatactagcagtggtgtccgtttccccattgcttttaacatcctcacagcaaaaaacggattggataccattagcattgacaatcaagggtctcaacccaacagctatttttctaacaaccctctcaagaaccagcaagaaaaggagctggccattaaatgaggctatcatggcagtcgggatggtgagcattttagccagttctctcctaaaaaatgatattcccatgacaggaccactagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcaataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaatcaagcaaaaagggattcttggatattcccagatcggagccggagtttacaaagaaggaacattccatacaatgtggcatgtcacacgtggcgctgtcctaatgcacaaaggaaagaggattgaaccatcatgggcggacgtcaagaaagatctaatatcatatggaggaggctggaagttagaaggagaatggaaggaaggagaagaagtccaggtattggcattggagcctggaaaaaatccaagagccgtccaaacaaaacctggtcttttcagaaccaacgccggaacaataggtgccgtatctctggacttttctcctggaacgtcaggatctccaatcattgacaaaaaaggaaaagttgtgggtctttatggtaatggtgttgttacaaggagtggagcatatgtgagtgctatagcccagacagaaaaaagcattgaagacaacccagagatcgaagatgacattttccgaaagagaagactgaccatcatggacctccatccaggagcgggaaagacgaaaagataccttccggccatagtcagagaagctataaaacggggtttgagaacattaatcttggctcccactagagttgtggcagctgaaatggaggaagctcttagaggacttccaataagataccaaaccccagccatcagagctgagcacaccgggcgggagattgtggacctaatgtgtcatgccacatttaccatgaggctgctatcaccagttagagtgccaaactacaacctgattatcatggacgaagcccatttcacagacccagcaagtatagcagccagaggatacatctcaactcgagtggagatgggtgaggcagctgggattttcatgacagccactcccccgggaagcagagacccatttcctcagagcaatgcaccaatcatagatgaagaaagagaaatccctgaacgttcgtggaattctggacatgagtgggtcacggatttcaaagggaagactgtttggttcgttccaagtataaaagcaggaaatgatatagcagcttgcctgagaaaaaatggaaagaaagtgatacaactcagtaggaagacttttgattctgagtatgtcaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcatccctagcatgttcgaaccagagcgtgaaaaagtggatgccattgatggcgaataccgcttgagaggagaagcaaggaaaacctttgtagacttaatgagaagaggagacctaccagtctggttggcctacaaagtggcagctgaaggcatcaactacgcagacagaaggtggtgttttgatggaatcaagaacaaccaaatcttggaagaaaacgtggaagttgaaatctggacaaaagaaggggaaaggaagaaattgaaacccagatggctggatgctaggatctattctgacccactggcgctaaaagaatttaaggaatttgcagccggaagaaagtctctgaccctgaacctaatcacagaaatgggtaggcttccaacctttatgactcagaaggcaagagacgcactggacaacttagcagtgctgcacacggctgaagcaggtggaagggcgtacaatcatgctctcagtgaactgccggagaccctggagacattgcttttactgacactgctggctacagtcacgggagggatctttttattcttgatgagcgggaggggcatagggaagatgaccctgggaatgtgctgcataatcacggctagcatcctcctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtatccctaacagctatagccaaccaagccacagtgttaatgggtctcgggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagggaagctcagaaaagagcagcggcgggcatcatgaaaaatccaaccgtcgatggaataacagtgattgacctagatccaataccctatgatccaaagtttgaaaagcagttgggacaagtaatgctcctagtcctctgcgtgactcaagtattgatgatgaggactacatgggctctgtgtgaggctttaaccttagctaccgggcccatctccacactgtgggaaggaaatccaggaagattttggaacactaccattgcggtgtcaatggctaacatttttagagggagttacttggctggagctggacttctcttttctattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggttcagcaaaactgagatggttcgttgagagaaacatggtcacaccagaagggaaagtagtggacctcggttgtggcagaggaggctggtcatactattgtggaggactaaaaaacgtaagagaagtcaaaggcctaacaaaaggaggaccaggacacgaagaacccatccccatgtcaacatatgggtggaatctagtgcgtcttcaaagtggagtcgacgttttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagtcatagaaaaaatggaaacactgcaaaggaaatatggaggagccttagtgaggaatccactctcacgaaactccacacatgagatgtactgggtatctaatgcttccgggaacatagtgtcatcagtgaacatgatttcaaggatgttgatcaacagattcacaatgagacacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagacagtaggttttgggagctggttgacaaggaaaggaatctccatcttgaaggaaagtgtgaaacatgtgtgtacaacatgatgggaaaaagagagaagaagctaggggaattcggcaaggcaaaaggtagcagagccatatggtacatgtggcttggagctcgcttcctagagtttgaagccctaggattcctaaatgaagatcactggttctccagagagaactccctgagtggagtggaaggagaagggctgcacaagctaggttacattctaagagacgtgagcaagaaagagggaggagctatgtatgccgatgacacagcaggatgggacacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacattatatcgagaagagaccaaagaggtagtggacaagttggtacctatggactcaatactttcaccaatatggaagcccaactaatcagacagatggagggagaaggagtcttcaaaaacattcagcacctgacagtcacagaagaaatcgccgtgcaaaactggttggcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaacgattggacacaagtgcccttctgttcacaccatttccatgagctaatcatgaaagatggtcgcgtacttgttgttccatgtagaaaccaagatgaactgattggcagagcccgaatctcccaaggagcagggtggtctttgcgggagacggcctgtttggggaagtcctacgcccaaatgtggagcttgatgtacttccacagacgcgacctcaggctggcggcaaatgccatttgctcggcagtaccatcacattgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacttgggcaaagaacatccaagcagcaataaatcaagttagatcccttataggcaatgaggaatacacagattacatgccatccatgaaaagattcagaagagaagaggaagaagcaggagtcctgtggtag

SEQ ID NO: 707 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagccatcaatgttttgagagggttcaggaaagagattggaaggatgctgaacatcttgaataggagacgcagatctgcaggcatgatcattatgctgattccaacagtaatggcgttccatctaaccacacgcaacggagaaccacacatgatcgtcagtatacaagagaaagggaaaagtcttctgtttaagactgaggatggcgtgaacatgtgcaccctcatggccatggaccttggtgaattgtgtgaagacacaatcacgtacaagtgtccccttctaaggcagaatgagccagaagacatagactgttggtgcaactccacgtccacgtgggtaacctatgggacttgtaccaccacgggagaacatagaagagaaaaaagatcagtggcacttgttccacacgtgggaatgggactggagacgcgaaccgaaacatggatgtcatcagaaggggcctggaaacatgcccagagaatcgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcctagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgtccaacacaaggggaacccagcctaaaagaagagcaggataagaggttcgtctgcaaacactccatagtagacagagggtgggggaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccgtcacagaagcagaattgacaggttatggcaccgtcacgatggagtgctctccgagaacaggcctcgacttcaatgagatggtgttgctgcagatggaaaataaagcttggctggtgcacaggcaatggttcctagacctgccattaccatggctgcccggagcggacacacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttactcttcactggacatctcaagtgcaggctgagaatggacaagctacagctcaaaggaatgtcatactccatgtgcacaggaaagttcaaagttgtgaaggaaatagcagaaacacaacatggaacgatagttatcagagtgcaatatgaaggggacggttctccatgtaaaatcccttttgagataatggatctggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagctctatcggccaaatgtttgagacaacaatgaggggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaactcacgtagcacctcactgtctgtgtcactagtattggtaggaattgtgacactgtacttgggagtcatggtgcaggccgatagtggttgcgttgtgagctggaaaaacaaagaactgaaatgtggcagtgggattttcatcacagacaatgtgcacacatggacagaacaatacaagttccaaccagaatccccttcaaaactagcttcagctatccagaaagctcaagaagagggaatttgtgggatccgctcagtaacaagattggagaacataatgtggaaacaaataacaccagaattgaatcacattctagcagaaaatgaggtaaaattaactatcatgacaggagacatcaaaggaatcatgcaggcaggaaaacgatctctgcggcctcagcccactgagctaaagtattcatggaaaacatggggcaaagcaaaaatgctttccacagagtctcataaccaaacctttcttattgatggccccgaaacagcagaatgccccaacacaaatagagcttggaactcgttggaggttgaagactacggttttggagtgtttaccaccaacatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaagtcacacaccctctggagcaatggagtgctagaaagtgagatgataattccaaagaatctcgctggaccagtgtctcaacacaactatagaccaggttaccatacacaaatagcaggaccatggcatctaggtaagcttgagatggactttgatttctgcgatggaaccacagtggtagtgactgaggactgcggaaatagaggaccctctttaagaacaactactgcctctggaaaacttataacagaatggtgctgccgatcttgcacattaccacccctaagatacagaggtgaggatgggtgctggtatgggatggaaatcagaccattgaaagagaaagaagaaaatttggttaactccttggtcacagccggacatgggcagattgacaatttttcactaggagtcttgggaatggcattgttcctggaggaaatgcttaggacccgagtaggaacgaaacatgcaatactactagttgcagtttcttttgtgacattgatcacagggaacatgtcctttaaagacctaggaagagtggtggttatggtgggcgccaccatgacggatgatataggtatgggcgtaacttatcttgccctactagcagccttcaaagtcagaccaacttttgcagctggactactcttgagaaaactgacctccaaggaattgatgatgaccactataggaattgtactcctctcccaaagcactataccagagaccattcttgaattgactgatgcgttagccttaggcatgatggtcctcaaaatagtaagagacatggaaaagtatcaattagcagtgactatcatggctgtcttgtgcgtcccaaacgcagtgatactacaaaatgcatggaaagtgagttgcacaatactagcagtggtgtccgtttccccactgcttttgacatcctcacagcagaaaacggattggataccattagcattgacaatcaagggtctcaatccaacagccatttttctaacaaccctctcaagaaccaacaagaaaaggagctggccactaaatgaggctatcatggcagtcggaatggtgagcattttagccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggacgttccttcacctccacccatgggaaaggctgaactggaagatggagcttacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcattggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaacccagacattgaagatgacattttccgaaagagaaggctgaccatcatggacctccacccaggagcgggaaagacgaaaagataccttccagccatagtcagagaagctataaaacggggtttgagaacattaatcttggcccccaccagagtcgtggcagctgaaatggaggaagctctcagaggacttccaataagataccaaaccccagccatcagagctgagcacacagggcgggaaattgtggatctaatgtgtcatgccacatttaccatgaggctgttatcaccagttagagtgccaaactacaacttgattatcatggatgaagcccatttcacagacccagcaagtatagcagctagaggatacatctcaactcgagtggagatgggtgaagcagctgggattttcatgacagccactcctccgggaagcagagatccatttcctcagagcaatgcaccaatcatagatgaagaaagagaaatccctgaacgttcatggaattctggacatgagtgggtcacggattttaaagggaagactgtctggttcgttccaagcataaaagcaggaaatgatatagcagcttgcctgagaaaaaatggaaagaaagtgatacaacttagtaggaagacttttgattctgagtatgtcaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacctatgccagtgacccactctagtgcagcgcaaagaagagggaggataggaagaaatccgaaaaatgaaaatgaccagtacatatacatgggggaacctctggaaaatgatgaagactgtgcacactggaaagaagccaaaatgctcctagataacattaacacaccagaaggaatcattcccagtatgtttgagccagagcgtgaaaaggtggatgccattgatggcgaataccgcttgagaggagaagcaaggaaaacctttgtggacctaatgagaagaggagacctaccagtctggttggcctacaaagtggcagctgaaggcatcaactatgcagacagaaggtggtgttttgatggaatcaagaacaaccaaatcctggaagagaatgtagaagtcgaaatctggacaaaagaaggggaaaggaagaaattgaaacccagatggctggatgctaggatctactctgacccactggcgctaaaagaattcaaagaatttgcagccggaagaaagtctctgaccctgaacctaattacagaaatgggtaggcttccaacattcatgactcagaagactagagacgcactggacaacttagcagtgctgcacacggctgaggcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctatgttgtcatagccatcctcacagtggtggccgcaaccatggcaaacgagatgggtttcctagaaaaaacgaagaaagatcttggattaggaagcatcgcaacccagcaacccgagagcaacatcctggacatagatctacgccccgcatcagcatggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccattatagggccaggacttcaagcaaaagcaaccagagaagctcagaaaagagcagcggcgggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcaatgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctgacaaaaggaggaccaggacacgaagaacccatccctatgtcaacatatgggtggaatctagtgcgtcttcaaagtggagttgacgttttcttcatcccgcccgaaaagtgtgacacattgctgtgtgacataggggagtcatcaccaaatcctacagtggaagcaggacgaacactcagagtccttaatttagtagaaaattggttgaacaacaacactcaattttgcataaaagtcctcaacccatatatgccctcagttatagaaaaaatggaaacactgcaaaggaaatatggaggagccttagtgagaaatccactctcacggaactccacacatgagatgtactgggtatccaacgcttccgggaacatagtgtcatcagtgaacatgatttcaaggatgttgatcaacagatttacaatgagacacaagaaagccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttctgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgctttctggagtttgaagccctaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatctagaaaagaccaaagaggtagtgggcaagttggtacctatggactcaatactttcaccaatatggaagcccaattgatcagacagatggagggagaaggagtttttaaaaacattcagcacctgacagtcacagaagaaatcgccgtgcaaaactggttagcaagagtggggcgcgaaaggttatcaagaatggccatcagtggagatgattgtgttgtgaaacctttagatgacaggttcgcaagcgccttgacagctctaaatgacatgggaaagattagaaaagacatacaacaatgggaaccttcaaggggatggaacgattggacacaagtgcccttctgttcacaccatttccatgagctaatcatgaaggatggtcgtgtacttgttgttccatgcagaaaccaagatgaactgattggcagagcccgaatctcccaaggagcagggtggtctttgcgggagacggcttgtttggggaagtcttacgcccaaatgtggagcttgatgtatttccacagacgcgacctcaggttggcggcaaatgccatttgctcggcagtgccatcacattgggttccaacaagtcgaacaacctggtctatacacgccaaacatgaatggatgacaacggaagacatgctgacagtctggaatagggtgtggattcaggaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 708 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaattaaaaaatcaaaagccattaatgttttgagagggttcaggaaagagatcggaaggatgctgaacatcttgaataggagacgcaggtctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttttagacctgccattaccatggctgcccggagcggataaacaagagtcaaattggatacagaaagaaacattggtcacttttaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactctatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaataaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttaactatcatgacaggagacatcaaaggaaccatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagccgggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggtagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagtgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccgggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccaaatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactgaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgaccaagaccacccatataaaacgtgggcataccatggtagctatgaaacaaaacagactggatcagcatcatccatggtcaacggagtggtcaggctgctgacaaaaccttgggacgttctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacattcagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagacatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgcaatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 709 - DNA, 10176 bp, Dengue virus
atgaataaccaacggaaaaaggcgagaaacacgcctttcaatatgctgaaacgcgagagaaaccgcgtatcaactgtacaacagttgacaaagagattctcacttggaatgctgcagggacgaggaccactaaaattgttcatggccctggtggcattccttcgtttcctaacaatcccaccaacagcagggatattaaaaagatggggaacaattaaaaaatcaaaggctattaatgttctaagaggcttcaggaaagagattggaaggatgctgaacatcttaaacaggagacgtagaactgcaggcatgatcatcatgctgattccaacagtgatggcgtttcatctgaccacacgcaacggagaaccacacatgatcgtcagtagacaagaaaaagggaaaagccttctgtttaagacaaaggatggcacgaacatgtgtactctcatggccatggaccttggtgagttgtgtgaagacacaatcacgtataaatgtccttttctcaagcagaacgaaccagaagacatagattgttggtgcaactccacgtccacatgggtaacttacggaacatgtaccaccacaggagagcacagaagagaaaaaagatcagtggcgcttgttccacacgtgggaatgggattggaaacacgaactgaaacatggatgtcatcagaaggggcctggaaacatgcccagagaattgaaacttggattctgagacatccaggctttaccataatggccgcaatcctggcatacaccataggaacgacgcatttccaaagagtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaataaaccaacactggactttgaactgataaaaacagaagccaaacaacccgccaccttaaggaagtactgtatagaggctaaactgaccaacacgacaacagactcgcgctgcccaacacaaggggaacccaccctgaatgaagagcaggacaaaaggtttgtctgcaaacattctatggtagacagaggatggggaaatggatgtggattgtttggaaaaggaggcatcgtgacctgtgctatgttcacatgcaaaaagaacatggaagggaaaattgtgcagccagaaaacctggaatacactgtcgtgataacacctcattcaggggaagaacatgcagtcggaaatgacacaggaaaacatggtaaagaagtcaagataacaccacagagctccatcacagaggcggaactgacaggctatggcactgttacgatggagtgctctccaagaacgggcctcgacttcaatgagatggtgttgctgcaaatggaagacaaagcttggctggtgcacagacaatggttcctagacctaccgttgccatggctgcccggagcagacacacaaggatcaaattggatacagaaagagacattggtcaccttcaaaaatccccatgcgaaaaaacaggatgttgttgtcttaggatcccaagaaggggccatgcacacagcactcacaggggccacggaaatccaaatgtcatcaggaaacctgctgttcacaggacatctcaaatgcaggctgagaatggacaaattacaacttaaagggatgtcatactccatgtgcacaggaaagtttaaaattgtgaaggaaatagcagaaacacaacatggaacaatagtcattagagtacaatatgagggagacggctctccatgcaagatcccctttgagataatggatctggaaaaaagacatgttttgggccgcctgatcacagtcaacccaattgtaacagaaaaggacagtccagtcaacatagaagcagaacctccattcggagacagctacatcatcataggagtggaaccaggacaattgaagctagactggttcaagaaaggaagttccatcggccaaatgtttgagacaacaatgaggggagcgaaaagaatggccatcttgggcgacacagcctgggattttggatctctgggaggaatgttcacatcaataggaaaagctctccaccaggtttttggagcaatctacggggctgctttcagtggggtctcatggacaatgaagatccttataggagtaattatcacatggataggaatgaactcacgtagcacatcactgtctgtgtcactggtattagtgggaatcgtgacactgtacttgggagttatggtgcaagccgatagtggttgcgttgtgagctggaagaacaaagaattaaaatgtggcagtggaatattcgtcacagataacgtgcacacatggacagaacaatacaagtttcaaccagaatccccttcaaaactggcttcagccatccagaaagctcacgaagaaggcatctgtggaatccgctcagtaacaagactggaaaatcttatgtggaaacagataacaccagaattgaatcatattctatcagaaaatgaagtgaaactgaccatcatgacaggagacaccaaaggaatcatgcaggtaggaaaacgatctctgcggcctcaacccactgagttgagatattcatggaaaacatggggtaaagcgaaaatgctccccacagaactccataatcagaccttcctcattgatggtcctgaaacagcagaatgccccaacacaaacagagcttggaattcactagaagttgaggactatggctttggagtattcactaccaacatatggctaagattgagagaaaagcaggatgtattttgtgactcaaaactcatgtcagcggccataaaggataacagagccgtccatgctgatatgggttattggatagaaagcgcactcaatgatacatggaagatagagaaagcttctttcattgaagtcaaaagttgccactggccaaagtcacacactctatggagtaatggagtgctagaaagcgagatggtaattccaaagaatctcgctggaccagtgtcacaacataataacagaccaggctatcacacacaaacagcaggaccttggcatctaggcaagcttgagatggactttaatttctgcgaagggaccacagtggtggtaaccgaggaatgtggaaacagagggccttctttaagaacaaccactgcctcaggaaaactcataacggaatggtgttgtcgatcttgcacactaccaccactaagatacagaggtgaggatggatgctggtacgggatggaaatcagaccattgaaagagaaagaagaaaatctggtcagttctctggtcacagccggacatgggcagattgacaatttctcattaggaattttgggaatggcactgttccttgaagaaatgctcaggactcgagtaggaacgaaacatgcaatactactagtcgcagtttctttcgtaacgttaatcacagggaacatgtcttttagagacctgggaagagtgatggttatggtgggtgccactatgacagatgacataggcatgggtgtaacttatcttgctctactagcagcctacaaagtcagaccaacctttgcagctggattactcttgagaaaactgacctccaaggaattaatgatgaccaccataggaatcgttcttctctctcagagtagcataccagagaccattcttgagctgaccgatgcgttagctttaggcatgatggtcctcaagatggtgagaaacatggaaaaatatcagctggcagtgactatcatggctattttgtgtgtcccaaatgctgtgatattacagaacgcatggaaagtgagttgcacaatactggcagtggtgtctgtttcccccctgctcttgacatcctcacaacagaaagcggactggataccattagcgttgacgatcaaaggcctcaatccaacagccatttttctaacaaccctctcaagaactagcaagaaaaggagctggcctttaaacgaggccatcatggcggttgggatggtgagtatcttggccagctctctcttgaagaacgacatccccatgacaggaccattagtggctggagggcttcttactgtgtgctacgtgttgactgggcggtcagccgatctggaactagagagagctaccgatgtcaaatgggatgaccaggcagagatatcaggtagcagtccaattctgtcaataacaatatcagaagatggcagcatgtcgataaagaatgaagaggaagagcaaacactgactatactcattagaacaggattgcttgtgatctcaggactctttccggtatcaataccaattacagcagcagcatggtacctgtgggaagtaaagaaacagcgggctggagtgttgtgggatgtcccctcaccaccacccgtgggaaaggctgaattggaagatggagcctacagaatcaagcaaaaaggaatcctaggatattcccagatcggagctggagtttacaaagagggaacatttcacaccatgtggcacgtcacacgtggcgctgtcctaatgcataaggggaagaggattgaaccgtcatgggcggacgtcaagaaagacttaatatcatatggaggaggttggaagctagaaggagaatggaaagaaggagaagaagtccaggttttggcattggagcctgggaaaaatccaagagccgtccaaacaaaacctggcctttttagaaccaatactggaaccataggtgccgtatccctagacttttcccctgggacgtcaggatctccaatcgttgacaaaaaaggaaaagttgtaggcctctatggcaatggtgtcgtcacaaggagtggagcatatgtgagtgccatagctcagactgaaaaaagcattgaagacaatccagagattgaagatgacatctttcgaaagagaagattgactatcatggatctccacccaggagcaggaaagacaaagaaatacctcccggccatagtcagagaggccataaaaagaggcttgagaacactaatccttgcccccactagagtcgtggcagctgagatggaggaagcccttagaggacttccaataagataccaaactccagctatcagggctgaacacaccgggcgggagatcgtggacttaatgtgtcatgccacatttaccatgaggctgctatcaccaatcagggtgccaaattacaacctgatcatcatggacgaagcccattttacagatccagcaagcatagcagctaggggatacatctcaactcgagtggagatgggtgaggcagctggaatttttatgacagccactcctccgggtagcagagatccatttcctcagagtaatgcaccaattatggatgaagaaagagaaattccggaacgttcatggaactccgggcacgagtgggtcacggattttaaaggaaagactgtctggtttgttccaagcataaaaaccggaaatgacatagcagcctgcctgagaaagaatggaaagagggtgatacagctcagtaggaagacctttgattctgaatacgtcaagactagaaccaatgactgggatttcgtggttacaactgacatttcggaaatgggtgccaactttaaagctgagagggttatagaccccagacgctgcatgaaaccagttatactgacagacggcgaagagcgggtgatcctggcaggacccatgccagtgacccactccagtgcagcacaaagaagagggagaataggaaggaatccaaggaatgaaaatgatcaatacatatatatgggagaacccctggaaaatgatgaagactgtgcgcactggaaggaagctaagatgctcctagataacatcaacacacctgaaggaattattcccagcatgttcgggccagagcgtgaaaaggtggatgccattgacggtgaatatcgcttgagaggagaagcacggaaaacttttgtggaactaatgagaagaggagacctaccagtctggttggcttataaagtggcatctgaaggtatcaactacgcagacagaagatggtgttttgacggaaccagaaacaatcaaatcttggaagaaaatgtggaagtggaaatctggacaaaggaaggggaaaggaaaaaattgaaacctagatggctagatgctaggatctactccgacccactggcgctaaaagaattcaaggaattcgcagccggaagaaagtctctaaccctgaacctaatcacagagatgggcagactcccaacttttatgactcagaaggccagagacgcactagacaacttggcggtgctgcacacggctgaagcgggtggaaaggcatacaatcatgctctcagtgaactaccggagaccctggaaacattgcttttgctgacactgctggccacagtcacgggaggaatctttctattcctgatgagcggaaggggtatagggaagatgaccctgggaatgtgttgcataatcacggccagcatcctcttatggtatgcacaaatacaaccacattggatagcagcttcaataatattggagttctttctcatagtcttgctcattccagaaccagaaaagcagaggacaccccaggataatcaattgacttatgtcatcatagccatcctcacagtggtggccgcaaccatggctaacgaaatgggttttctagaaaaaacaaagaaagacctcggactgggacacattgcaactcagcaacctgagagcaacattctggacatagatctacgtcctgcatcagcatggacgttgtatgccgtggctacaacatttatcacaccaatgttgagacatagcattgaaaattcttcagtaaatgtgtctctaacagccatagctaaccaagccacagtgctaatgggtctcgggaaaggatggccattgtcaaagatggacattggagttcccctccttgctattgggtgttactcacaagttaaccctataaccctcacagcggctcttcttttattggtagcacattatgccatcataggaccgggacttcaagccaaagcaaccagagaggctcagaaaagagcagcggcgggcatcatgaaaaacccaactgtggatggaataacagtgatagatctagatccaataccctatgatccaaagtttgaaaagcagttgggacaagtaatgctcctagtcctttgtgtgacccaagtgctgatgatgaggactacgtgggctttgtgtgaagccttaactctggcaactggacccgtgtccacattgtgggaaggaaatccagggagattctggaacacaaccattgcagtctcaatggcaaacatctttagagggagttaccttgctggagctggacttctcttttctatcatgaaaaacacaactagcacgagaagaggaactggcaacataggagaaacgctaggagagaaatggaaaagcagactgaacgcattggggaaaagtgaattccagatctacaaaaaaagtggaattcaagaagtggacagaaccttagcaaaagaaggcattaaaagaggagaaacggatcatcacgctgtgtcgcgaggatcagcaaaactgagatggttcgtcgaaagaaatttggtcacaccagaagggaaagtagtggaccttggctgcggcagagggggctggtcatactattgtggaggattgaagaatgtaagagaagttaaaggcttaacaaaaggaggaccaggacacgaagaacctatccctatgtcaacatatgggtggaatctagtacgcttacagagcggagttgacgttttttttattccaccagagaagtgtgacacactgttgtgtgacataggggaatcatcaccaaatcccacggtagaagcgggacgaacactcagggtccttaacctagtggaaagttggctgaacaataacacccaattttgcgtaaaggttcttaacccgtacatgccctcagtcattgaaagaatggaaaccttacaacggaaatacggaggagccttggtgagaaatccactctcacggaattccacacatgaaatgtactgggtgtccaatgcttccgggaacgtagtatcatcagtgaacatgatttcaagaatgctgattaacagattcaccatgagacacaagaaggccacctatgagccagatgtcgacctcggaagcggaacccgcaacattggaattgaaagtgagacaccgaacctagacataattgggaaaagaatagaaaaaataaaacaagagcatgaagcgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtctttaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacgaaaaaggtgagaagcaatgcagccttgggggccatatttaccgatgagaacaagtggaaatcggcacgtgaagctgttgaagataataggttttgggagctggttgacaaggaaagaaacctccatcttgaaggaaaatgtgaaacatgtgtatacaacatgatgggaaaaagagagaaaaaactaggagagtttggtaaagcaaaaggcagcagagccatatggtacatgtggctcggagcacgcttcttagagtttgaagccctaggatttttgaatgaagaccattggttctccagagagaactccctgagtggagtggaaggagaaggactgcataaactaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacataagaaacttgccgaggccatttttaaattgacgtaccaaaacaaggtggtgcgtgtgcaaagaccaacaccaataggtacagtaatggacatcatatcgagaagagaccaaaggggtagtgggcaagttggcacctatggcctcaacactttcaccaacatggaagcacaactaatcaggcaaatggagggggaaggaatcttcaaaagcatccagcacttgacagcctcagaagaaatcgctgtgcaagattggctagtaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtgcccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtactttcacagacgtgatctcaggctagcggcaaacgccatctgctcggcagtcccgtcacactgggttccaacaagccggacaacctggtccatacacgccagccatgaatggatgacgactgaagacatgttgacagtttggaacagagtgtggatcctagaaaatccatggatggaagacaaaactccagtggaatcatgggaggaaatcccatatctgggaaaaagagaagaccaatggtgcggctcgctgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtggtag

SEQ ID NO: 710 - DNA, 10176 bp, Dengue virus
atgaatgaccaacggaaagaggcgaaaaacacgccattcaatatgctgaaacgcgagagaaaccgcgtgtcgactgtgcaacagctgacaaagagattctcacttggaatgctccagggacgaggaccattaaaactatacatggccctggtggcgttccttcgtttcctaacaatcccaccaacagcagggatattgaagagatggggaacaattaaaaaatccaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggttggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttaatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaagggaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactatcacaatggagtgctctccaagaacgggcctagacttcaatgagatcgtgttgctgcagatggaaaataaagcttggctcgtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccatttggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgatagtggttgcgttgtgagctggaaaaacaaagaactgaaatgtggcagtggtattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttttcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtactagaaagtgagatgattattccaaagaatctcgctggaccagtgtctaaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcatagggaacaggtcctttagagacctgggaagagtaatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactctcctcccagagcactataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacggattggataccattagcgttgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaagaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggaccctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagtattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgagcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgttcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaccacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagaaacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctaggattaggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccacaactctcacagcagctcttttcttattggtagcacattatgccatcatagggccagcactccaagcaaaagcatccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtcggaaggaaatccagggaggttttggaacactaccattgcggtgtcaatggctaacatttttagagggagttacttggccggagctggacttctcttttctattatgaagaacacaaccaacacaagaagggtaactggtaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtgttcaggctgctgacaaaaccttgggacgttgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatcatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtccgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttgccaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtag

SEQ ID NO: 711 - DNA, 10176 bp, Dengue virus
atgaatgaccaacggaaaaaggcgaaaaacacgccattcaatatgctgaaacgcgagagaaaccgcgtgtcgactgtgcaacagctgacaaagagattctcacttggaatgctacagggacgaggaccactaaaactgtacatggccctggtggcgttccttcgtttcctaacaatcccaccaacagcagggatattgaagagatggggaacaattaaaaaatccaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacctccacgtgggtaacttatgggacgtgtaccaccatgggagaacatagaagacaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccaccacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagagggcatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagtcaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcatagggaacatgtcctttagagacctgggaagagtaatggttatggtaggcgccactatgacggatgacataggtatgggcgtgacttatcttgccctactagcagccttcaaagtcagaccaacttttgcagctggactactcttgagaaagctgacctccaaggcattgatgatgactactataggaattgtactctcctcccagagcactacaccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacgatattggcagtggtgtccgtttccccactgttcttaacatcctcacagcaaaaaacggattggataccattagcgttgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggcccctcactgtgtgctacgtgctcactggacgatcggccgatttggaactggagagagcagccgatgtcaaatgggaagaccaggcagagatatcaggaagcagcccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagtattgaagacaacccagagatcgaagatgacattttccgaaaaagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgagcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgttcgtggaattccggacatgaatgggtcacggattttaaagggaagactgtttggttcgttccaagtataaaagcaggaaatgatatagcagcttgcctgagcaaaaatggaaagaaagtgatacaactcagtaggaagacctttgattctgagtatgccaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacccctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaccacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatccttttattcttgatgagcggaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctaggattaggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccacaactctcacagcagctcttttcttattggtagcacattatgccatcatagggccagcactccaagcaaaagcatccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggttttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacgcaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtgttcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatcatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagatctaaaaaatgaagcaatggtaacaaaccacatggaaggagaacacaagaaactagccgaggccattttcaaactaacgtaccaaaacaaggtggtccgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttgccaagcgctttaacagctctaaatgacacaggaaagattaggaaagacatacaacaatgggaaccttcaagaggatggaatgattggacacaagtgcccttctgttcacaccatttccatgagttaatcatgaaagacggccgcgtactcgttgttccatgtagaaaccaagatgaactgattggcagagcccgaatctcccaaggagcagggtggtctttgcgggagacggcctgtttggggaagtcttacgaccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtag

SEQ ID NO: 712 - DNA, 10176 bp, Dengue virus; identical to SEQ ID NO: 653

SEQ ID NO: 713 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgcaggcatgatcattatgttgattccaacagtgatggcgttccatctaaccacacgtaacggagaaccacacatgatcgtcagtagacaagagaaagggaaaagtcttctgtttaaaacagaggatggtgtgaacatgtgcaccctcatggccatggaccttggtgaattgtgtgaagacacaatcacgtacaagtgtccccttctcaggcagaatgagccagaagacatagactgttggtgcaactccacgtccacatgggtaacttatgggacttgtactaccacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcagcaatcctggcatataccatagggacgacacatttccagagagccctgattttcatcttactgacagctgtcgctccttcaatgacaatgcgttgcataggaatatcaaatagagactttgtagaaggggtttcaggaggaagctgggttgacatagtcttagaacatggaagctgcgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggattgtttgggaagggaggcattgtgacctgtgctatgtttacatgcaaaaagaacatggaaggaaaagttgtgcaaccagaaaacttggaatacaccattgtggtaacacctcactcaggggaagagcatgcggtcggaaatgacacaggaaaacatggcaaggaaatcaaagtaacaccgcagagttccatcacagaagcagaattgacaggctatggcactgtcacgatggagtgctctccgagaacaggcctcgacttcaatgagatggtgttgctgcagatggaaaacaaagcttggctggtgcacaggcaatggttcctagacctgccgttaccatggctgcccggagcggatacacaagggtcaaattggatacagaaagagacattggtcactttcaaaaatccccatgcgaagaaacaggatgttgttgtttttggatcccaagaaggggccatgcacacagcactcacaggggccacagaaatccaaatgtcatcaggaaatttactcttcacaggacatctcaagtgcaggctgagaatggccaagctacagctcaaaggaatgtcatactctatgtgcacaggaaagtttaaagttgtgaaggaaatagcagaaacacaacatggaacaatagttatcagagtgcaatatgaaggggacggctctccatgtaaaatcccttttgagataatggatttggaaaaaagacatgtcttaggtcgcctgatcacagtcaacccaattgtgacagaaaaagatagcccagtcaacatagaagcagaacctccattcggagacagctacatcatcataggagtagacccgggacaactgaagctcaactggtttaagaaaggaagttctatcggccaaatgtttgagacaacaatgaggggggcgaagagaatggccattttgggtgacacagcctgggattttggatccctgggaggagtgtttacatctataggaaaagctctccaccaagtctttggagcaatctatggagccgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtggaatccgctcagtaacaagactggagaatctgatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacagcagaatgccccaacacaaatagagcttggaattcgttggaagttgaagactacggctttggagtattcaccaccaatatatggctaaaattgaaagaaaaacaggatgcattctgcgactcaaaactcatgtcagcggccataaaagacaatagagccgtccatgccgatatgggttattggatagaaagtgcactcaatgacacatggaagatagagaaagcctctttcattgaagttaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaactacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaagagaaagaagaaaatttggttaactccttggtcacagccggacatgggcagattgacaacttttcactaggagtcttgggaatggcattgttcctggaggaaatgcttaggacccgagtaggaacgaaacatgcaatactactagttgcagtttcttttgtgacattgatcacagggaacatgtcctttagagacctagggagagtggtggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccaaagcaccataccagagaccattcttgaattgactgatgcgttagccttgggcatgatggtcctcaaaatggtaagaaatatggaaaagtatcaattagcagtgactatcatggctatcttgtgcgtcccaaacgcagtgatattacaaaacgcatggaaagtgagttgcacaatactagcagtggtgtccgtttccccattgcttttaacatcctcacagcaaaaaacggattggataccattagcattgacaatcaagggtctcaacccaacagctatttttctaacaaccctctcaagaaccagcaagaaaaggagctggccattaaatgaggctatcatggcagtcgggatggtgagcattttagccagttctctcctaaaaaatgatattcccatgacaggaccactagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcaataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaatcaagcaaaaagggattcttggatattcccagatcggagccggagtttacaaagaaggaacattccatacaatgtggcatgtcacacgtggcgctgtcctaatgcacaaaggaaagaggattgaaccatcatgggcggacgtcaagaaagatctaatatcatatggaggaggctggaagttagaaggagaatggaaggaaggagaagaagtccaggtattggcattggagcctggaaaaaatccaagagccgtccaaacaaaacctggtcttttcagaaccaacgccggaacaataggtgccgtatctctggacttttctcctggaacgtcaggatctccaatcattgacaaaaaaggaaaagttgtgggtctttatggtaatggtgttgttacaaggagtggagcatatgtgagtgctatagcccagacagaaaaaagcattgaagacaacccagagatcgaagatgacattttccgaaagagaagactgaccatcatggacctccatccaggagcgggaaagacgaaaagataccttccggccatagtcagagaagctataaaacggggtttgagaacattaatcttggctcccactagagttgtggcagctgaaatggaggaagctcttagaggacttccaataagataccaaaccccagccatcagagctgagcacaccgggcgggagattgtggacctaatgtgtcatgccacatttaccatgaggctgctatcaccagttagagtgccaaactacaacctgattatcatggacgaagcccatttcacagacccagcaagtatagcagccagaggatacatctcaactcgagtggagatgggtgaggcagctgggattttcatgacagccactcccccgggaagcagagacccatttcctcagagcaatgcaccaatcatagatgaagaaagagaaatccctgaacgttcgtggaattctggacatgagtgggtcacggatttcaaagggaagactgtttggttcgttccaagtataaaagcaggaaatgatatagcagcttgcctgagaaaaaatggaaagaaagtgatacaactcagtaggaagacttttgattctgagtatgtcaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcatccctagcatgttcgaaccagagcgtgaaaaagtggatgccattgatggcgaataccgcttgagaggagaagcaaggaaaacctttgtagacttaatgagaagaggagacctaccagtctggttggcctacaaagtggcagctgaaggcatcaactacgcagacagaaggtggtgttttgatggaatcaagaacaaccaaatcttggaagaaaacgtggaagttgaaatctggacaaaagaaggggaaaggaagaaattgaaacccagatggctggatgctaggatctattctgacccactggcgctaaaagaatttaaggaatttgcagccggaagaaagtctctgaccctgaacctaatcacagaaatgggtaggcttccaacctttatgactcagaaggcaagagacgcactggacaacttagcagtgctgcacacggctgaagcaggtggaagggcgtacaatcatgctctcagtgaactgccggagaccctggagacattgcttttactgacactgctggctacagtcacgggagggatctttttattcttgatgagcgggaggggcatagggaagatgaccctgggaatgtgctgcataatcacggctagcatcctcctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtatccctaacagctatagccaaccaagccacagtgttaatgggtctcgggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagggaagctcagaaaagagcagcggcgggcatcatgaaaaatccaaccgtcgatggaataacagtgattgacctagatccaataccctatgatccaaagtttgaaaagcagttgggacaagtaatgctcctagtcctctgcgtgactcaagtattgatgatgaggactacatgggctctgtgtgaggctttaaccttagctaccgggcccatctccacactgtgggaaggaaatccaggaagattttggaacactaccattgcggtgtcaatggctaacatttttagagggagttacttggctggagctggacttctcttttctattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggttcagcaaaactgagatggttcgttgagagaaacatggtcacaccagaagggaaagtagtggacctcggttgtggcagaggaggctggtcatactattgtggaggactaaaaaacgtaagagaagtcaaaggcctaacaaaaggaggaccaggacacgaagaacccatccccatgtcaacatatgggtggaatctagtgcgtcttcaaagtggagtcgacgttttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagtcatagaaaaaatggaaacactgcaaaggaaatatggaggagccttagtgaggaatccactctcacgaaactccacacatgagatgtactgggtatctaatgcttccgggaacatagtgtcatcagtgaacatgatttcaaggatgttgatcaacagattcacaatgagacacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagacagtaggttttgggagctggttgacaaggaaaggaatctccatcttgaaggaaagtgtgaaacatgtgtgtacaacatgatgggaaaaagagagaagaagctaggggaattcggcaaggcaaaaggtagcagagccatatggtacatgtggcttggagctcgcttcctagagtttgaagccctaggattcctaaatgaagatcactggttctccagagagaactccctgagtggagtggaaggagaagggctgcacaagctaggttacattctaagagacgtgagcaagaaagagggaggagctatgtatgccgatgacacagcaggatgggacacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacattatatcgagaagagaccaaagaggtagtggacaagttggtacctatggactcaatactttcacccatatggaagcccaactaatcagacagatggagggagaaggagtcttcaaaaacattcagcacctgacagtcacagaagaaatcgccgtgcaaaactggttggcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaacgattggacacaagtgcccttctgttcacaccatttccatgagctaatcatgaaagatggtcgcgtacttgttgttccatgtagaaaccaagatgaactgattggcagagcccgaatctcccaaggagcagggtggtctttgcgggagacggcctgtttggggaagtcctacgcccaaatgtggagcttgatgtacttccacagacgcgacctcaggctggcggcaaatgccatttgctcggcagtaccatcacattgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaggaatacacagattacatgccatccatgaaaagatttagaagagaagaggaagaagcaggagtcctgtggtag

SEQ ID NO: 714 - DNA, 10176 bp, Dengue virus
atgaataaccaacggaaaaaggcgaaaaacacgcctttcaatatgctgaaacgcgagagaaaccgcgtgtcgactgtgcaacagctgacgaagagattctcacttggaatgctgcagggacgaggaccattaaaactgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgtaggcatgatcattatgctgattccaacagtaatggcgttccatctgaccacacgcaacggagaaccacatatgatcgtcagtatacaagagaaagggaaaagtctcctgtttaaaacagaggatggcgtgaacatgtgcaccctcatggccatggaccttggtgaattgtgtgaagacacaatcacgtacaagtgtccccttctcagacagaatgagccagaagacatagattgttggtgcaactccacgtccacgtgggtaacctatgggacttgtaccaccacgggagaacatagaagagaaaaaagatcagtggcactcgttccacatgtgggaatgggactggaaacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcttgctgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcaccttcaaaaatccccatgcgaagaaacaggatgttgttgttttaggatcccaagaaggggccatgcatacagcactcacaggagccacggaaatccaaatgtcgtcaggaaacttactcttcactggacatctcaagtgcaggctgagaatggacaagctacagctcaaaggaatgtcatactctatgtgcacaggaaagtttaaagttgtgaaggaaatagcagaaacacaacatggaacaatagtcatcagagtgcaatatgaaggggacggctctccatgtaaagtcccttttgagataatggatttggaaaaaagatatgtcttaggccgcctgatcacagtcaacccagttgtgacagaaaaagatagcccagtcaacatagaagcagaacctccattcggagacagctacatcatcataggagtagagccgggacaactgaagctcaactggttcaagaaaggaagttctatcggccagatgtttgagacaacaatgaggggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtgttggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagactggagaacctaatgtggaaacagataacaccagaattgaatcacattctagcagaaaatgaggtgaagttaactattatgacaggagacatcaaaggaatcatgcaggcaggaaaacgatctctgcggcctcagcccactgagctaaagtactcatggaaaacatggggcaaagcaaaaatgctctccacagagtctcataaccaaacttttctcattgatggccccgaaacagcagaatgccccaacacaaatagagcttggaactcattggaggttgaagactacggttttggagtgttcaccaccaatatatggctaaaattgaaagaaaaacaggatgcattctgcgactcaaaactcatgtcagcggccgtaaaagacaacagagccgtccatgccgacatgggttattggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtggtgactgaggactgcggaaatagaggaccctctttgagaacaactactgcctctggaaaactcataacagaatggtgctgccgatcttgcacattgccacccctaagatatagaggtgaggatgggtgctggtacgggatggaaatcagaccattgaaagagaaagaagaaaatttggttaactccttggtcacagccggacaagggcaggttgacaatttttcactaggagtcttgggaatggcattgttcctggaggaaatgcttaggacccgagtaggaacgaaacatgcaatactactagttgcagtttcttttgtgacattgatcacagggaacatgtcctttaaagacctaggaagagtggtggttatggtaggggccaccatgacggatgacataggtatgggcgtaacttatcttgccctactagcagcctttaaagtcagaccaacttttgcagctggactactcttgagaaagctgacctccaaggaattgatgatgaccaccataggaattgtactcctctctcaaagcactataccagaaaccatccttgaattgactgatgcgttagccttaggcatgatggtcctcaaaatagtaagagacatggaaaagtatcaattggcagtgactatcatggctatcttgtgcgtcccaaacgcagtgatattacaaaatgcatggaaagtgagttgcacaatactagcagtggtgtccgtttccccactgcttttgacatcctcacagcaaaaaacggattggataccattagcattgacaatcaagggtctcaatccaacagccatctttctaacaactctctcaagaaccaacaagaaaaggagctggccactaaatgaggccatcatggcagtcggaatggtgagcattttagccagttctctcctaaaaaatgatatccctatgacaggaccactagtggctggagggctcctcactgtatgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtactgtgggatgttccttcacccccacccatgggaaaggctgaactggaagatggagcctacagaatcaagcaaaaagggattcttggatattcccagatcggagctggagtttataaagaaggaacattccatacgatgtggcatgtcacacgtggcgctgtcctaatgcataaaggaaagaggattgaaccatcatgggcggacgtcaaaaaagatctaatatcatatggaggaggctggaagctagaaggagaatggaaggaaggagaagaagtccaggtgctggcattggagcctgggaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggcaatggtgttgttacaaggagtggagcatatgtgagtgctatagcccaaactgaaaaaagcattgaagacaacccagacatcgaagatgacattttccgaaagagaagactgaccatcatggacctccacccaggagcgggaaagacgaaaagataccttccggccatagtcagagaagccataaaacggggtttgagaacattaatcttggcccccaccagagttgtggcagctgaaatggaggaggctctcagaggacttccaataagataccaaaccccagccatcagagctgagcacacagggcgggaaattgtggatctaatgtgtcatgccacatttaccatgaggctgctatcaccagttagagtgccaaactacaacctgattatcatggatgaagcccatttcacagacccagcaagtatagcagctagaggatacatctcaactcgagtggagatgggtgaagcagctgggattttcatgacagccactcccccgggaagcagagatccatttcctcagagcaatgcaccgatcatagatgaagaaagagaaatccctgaacgttcatggaattctggacacgagtgggttacggattttaaagggaaaactgtttggttcgttccaagcataaaagcaggaaatgatatagcagcttgcctgagaaaaaatggaaagaaagtaatacaacttagtaggaagacttttgattctgagtatgccaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacattaacacaccagaaggaatcattcccagtatgtttgaaccagagcgtgaaaaagtggatgccattgatggcgaataccgcttgagaggagaggcaaggaaaacctttgtggacttaatgagaagaggagacctaccagtctggctggcctacaaagtggcagctgaaggcatcaactatgcagacagaaggtggtgttttgatggaatcaagaacaaccaaatcctggaagagaatgtggaagttgaaatttggacaaaagaaggggaaaggaagaaattgaaacccagatggctggatgctaggatctactctgacccactggcgctaaaagaattcaaagaatttgcagccggaagaaagtctctgaccctgaacctaattacagaaatgggtaggcttccaacattcatgactcagaagacaagagacgcactggacaacttagcagtgctgcacacggccgaagcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgcatagtcacggctagcatccttttatggtacgcacaaatacagccacactggatagcagcttcaataatactggagttttttctcatagttttgcttattccagaaccagaaaaacagagaacaccccaagacaaccaattaacctatgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgccccgcatcagcatggacgctgtatgccgtggctacaacatttgttacaccaatgctgagacatagtattgagaattcctcagtgaatgtatccctaacagctatagctaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccattatagggccaggacttcaagcaaaagcaaccagagaagctcagaaaagagcagcggcgggcatcatgaaaaacccaaccgttgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttggctaccgggcccatctccacactgtgggaaggaaatccaggaaggttctggaacactaccattgcggtgtcaatggccaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcgacatatgggtggaacctagtgcgtcttcaaagtggagttgacgttttcttcatcccaccagaaaagtgtgacacattgttgtgtgacataggggagtcttcaccaaaccccacagtggaagcaggacgaacactcagagtccttaatttagtagaaaattggttgaacaacaacactcaattttgcataaaggttctcaacccatatatgccctcagttatagagaaaatggaaacactgcaaaggaaatatggaggagccttagtgagaaatccactctcacggaactccacacatgagatgtactgggtatccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaacttagacataattgggaaaagaatagaaaaaataaagcaagagcatgaaacatcatggcactacgaccaagaccacccatacaaaacgtgggcgtaccatggtagctatgaaacaaaacagactggatcagcatcatccatggtcaacggagtggtcaggctgctgacaaaaccttgggacgtcctccccacggtgacacagatggcaatgacagacacgaccccatttggacaacagcgtgtttttaaagaaaaagtggacacgagaacccaagagccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggctcggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacattagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacattatatcgagaagagaccaaagaggcagtgggcaagttggcacctatggactcaatactttcaccaacatggaagcccaattaatcagacagatggagggagaaggagtttttaaaaacattcagcacctgacatccacagaagaaatcgccgtgcaaaactggttagcaagagtggggcgcgaaaggttatcaagaatggccatcagtggagatgattgtgttgtgaaacctttagatgacaggttcgcaagcgccttgacagctctgaatgacatgggaaagattagaaaagacatacaacaatgggaaccttcaagaggatggaacgattggacacaagtccccttctgttcacaccatttccatgagctaatcatgaaagatggtcgtgtacttgttgttccatgtagaaaccaagatgaactgattggcagagcccgaatttcccaaggagcagggtggtctttgcgggagacggcctgtttggggaagtcttacgcccaaatgtggagcttgatgtatttccacagacgcgacctcaggctggcggcaaatgccatttgctcggcggtgccatcacattgggttccaacaagtcgaacaacctggtccatacacgccaaacatgaatggatgacaacggaagacatgctgacagtctggaacagggtgtggattcaagaaaacccatggatggaagaaaaaaccccagtggaatcatgggaggaaatcccgtacttggggaaaagagaagaccaatggtgcggctcactgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 715 - DNA, 10176 bp, Dengue virus
atgaataaccaacggaaaaaggcgaaaaacacgcctttcaatatgctgaaacgcgagagaaaccgcgtgtcgactgtgcaacagctgacgaagagattctcacttggaatgctgcagggacgaggaccattaaaactgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgtaggcatgatcattatgctgattccaacagtaatggcgttccatctgaccacacgcaacggagaaccacatatgatcgtcagtatacaagagaaagggaaaagtctcctgtttaaaacagaggatggcgtgaacatgtgcaccctcatggccatggaccttggtgaattgtgtgaagacacaatcacgtacaagtgtccccttctcagacagaatgagccagaagacatagattgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggtttcaccataatggcagcaatcctggcatataccatagggacgacacatttccagagagccctgattttcatcctactgacagctgtcgctccttcaatgacaatgcgttgcataggaatatcaaatagagactttgtagaaggggtttcaggaggaagctgggttgacatagttttagaacatggaagctgtgtgacgacgatggcaaaaaacaaaccaacattggattttgaactgataaaaacggaagccaaacagcctgccaccctaagaaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggttggtgcataggcaatggttcctagacctgccattaccatggctgcccggagcggatacacaagggtcaaattggatacagaaagaaacattggtcactttcaagaatccccacgcgaagaaacaggatgttgttgttttaggatcccaagaaggggccatgcacacagcactcacaggagccacagaaatccaaatgtcgtcaggaaacttgctcttcactggacatctcaagtgcaggctgagaatggataagctacagctcaaagggatgtcatactctatgtgcacaggaaagttcaaagttgtgaaggaaatagcagaaacacaacatggaacgatagtcattagagtgcaatatgaaggggacggctccccatgtaaaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatccataggaaaagctctccaccaagtctttggagcaatctatggagctgccttcagtggggtttcatggactatgaaaatcctcataggagtcattatcacatggataggaatgaactcacgcagcacctcactgtctgtgtcactagtattggtgggaattgtgacactgtatttgggagtcatggtgcaggccgatagcggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggtaaagcaaaaatgctctccacagagtctcataaccaaacctttctcattgatggccccgaaacggcagagtgccccaacacaaatagagcttggaactcgttggaggttgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaaccactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccattcttgaattgactgatgcgatagccttaggcatgatggtccttaaaatagtaagaaacatggaaaagtatcaattagcagtgactatcatggctatcttgtgcgtcccaaacgcagtgatattacaaaatgcatggaaagtgagctgcacaatactggcagtggtgtccgtttctccactgcttttgacatcctcacagcaaaaaacggattggataccattagcattgacaatcaagggtctcaatccaacagccatttttctaacaaccctctcaagaaccaacaagaaaaggagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttataaagaaggaacattccatacaatgtggcatgtcacacgtggcgctgtcctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggcaatggtgttgttacaaggagtggagcatatgtgagtgctatagcccaaactgaaaaaagcattgaagacaacccagagatcgaagatgacattttccgaaagagaagactgaccatcatggacctccacccaggagcgggaaagacgaaaagataccttccggccatagtcagagaagctataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaattttaaagctgagagggttatagaccccagacgctgcatgaaaccagtcatactgacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcccagtatgtttgaaccagagcgtgaaaaagtggatgccattgatggcgaataccgcttgagaggagaagcaaggaaaacctttgtggacttaatgaggagaggagacctaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgctcttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttcttgccattggatgctactcacaagtcaatcccataactctcacagcagctcttctcttattggtagcgcattatgccatcatagggccaggacttcaagcaaaagcaaccagagaagcccagaaaagagcagcggcgggcatcatgaaaaacccaaccgtcgatggaataacagtgattgacctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcagtgtcaatggctaacatctttagagggagttacttggctggagctggacttctcttttccattatgaagaacacaaccaacacaagaaggggaacaggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggttcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcaaagtggagttgacgttttcttcatcccgccagaaaagtgtgacacattgttgtgtgacataggggagtcatcaccaaatcctacagtggaagcaggacgaacactcagagtccttaatttagtagaaaattggttgaacaacaacactcaattttgcataaaagttctcaacccatatatgccctcagttatagaaaaaatggaaacactgcaaaggaaatatggaggagccttagtgagaaatccactctcacggaactccacacatgagatgtactgggtatccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaacgcagccttgggggccatattcactgatgagaacaagtggaagtcggcacgtgaggctgttgaagatagcaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagcgatatggtacatgtggcttggagctcgcttcctggagtttgaagccctaggattcctaaatgaagatcactggttctccagagagaactccttgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccatcttcaaactaacgtaccaaaacaaggtggtgcgtgtgcaaagaccaacaccaagaggcacagtaatggacatcatatcaagaagagaccaaagaggtagtgggcaagttggtacctatggactcaatactttcaccaatatggaagcccaattaatcagacagatggagggagaaggagtttttaaaaacattcagcacctgacagtcacagaagaaatcgccgtgcagaactggttagcgagagtggggcgcgaaaggttatcaagaatggccatcagtggagatgattgtgttgtgaaacctttagatgacaggttcgcgagcgctttgacagctctaaatgacatgggaaagattagaaaagacatacaacaatgggaaccttcaagaggatggaacgattggacacaagtgcccttctgttcacaccatttccatgagctaatcatgaaggatggtcgcgtacttgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggttggcggcaaatgccatttgctcggcagtgccatcacattgggttccaacaagtcgaacaacctggtccatacacgccaaacatgaatggatgacaacggaagacatgctgacagtctggaatagggtgtggattcaagaaaacccatggatggaagacaaaaccccagtggaatcatgggaggaaatcccgtacttggggaaaagagaagaccaatggtgtggctcactgattgggttgacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 716 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggctctggtggcgttccttcgtttcctaacaatcccaccaacagcagggatattgaaaagatggggaacaattaaaaaatcaaaagccattaatgtcttgagagggttcaggaaagagattggaaggatgctgaacatcttgaataggagacgcagatctgcaggcgtgatcattatgctgattccaacagtgatggcgttccatctaaccacacgtaacggagaaccacacatgatcgtcagtagacaagagaaagggaaaagtcttctgtttaaaacagaggatggcgtgaacatgtgcaccctcatggccatggaccttggtgaattatgtgaagacacaatcacgtacaagtgtccccttctcaggcagaatgagccagaagacatagattgttggtgcaactccacgtccacgtgggtaacctatgggacttgtaccaccacgggagaacatagaagagaaaaaagatcagtggcacttgttccacatgtgggaatgggactggagacgcgaactgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatgggggaatggatgtggattgtttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagctccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcatcaggaaacttactcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggtttaagaaaggaagttctatcggccaaatgtttgagacaacaatgaggggggcgaagagaatggccattttgggtgacacagcctgggatttcggatccctgggaggagtgtttacatctataggaaaagctctccaccaagtctttggagcaatctatggagcggccttcagtggggtttcatggactatgaaaatcctcataggagtcattatcacatggataggaatgaattcacgcagcacctcactgtctgtgtcattagtattggtgggaattgtgacactgtatttgggagtcatggtgcaggccgatagtggttgcgtcgtgagctggaaaaacaaagaactgaaatgtggcagtggaatttttatcacagacaacgtgcacacatggacagaacaatacaagttccaaccagaatccccttcaaaactagcttcagctatccagaaagctcaagaagagggaatttgtggaatccgctcagtaacaagattggagaacctaatgtggaaacaaataacaccagaattgaatcacattttagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccctgaaacagcagaatgccccaacacaaatagagcttggaactcgttggaggttgaagattacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaacggagtgctagaaagtgagatgataattccaaagaatctcgctggaccagtgtctcaacacaactatagaccaggctatcatacacaaacagcaggaccatggcatctaggcaagcttgagatggactttgatttctgcgaaggaactacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactaggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccgccatgacggatgacataggcatgggcgtgacttatcttgccctactagcagccttcaaagttagaccaacttttgcagctggactactcttgagaaagctgacctccaaggaattgatgatgactaccataggaattgtactcctctcccaaagcaccataccagagaccattcttgaattgactgatgcgttagccttaggcatgatggtcctcaaaatggtaagaaacatggaaaagtatcaattagcagtgaccatcatggctatcttgtgcgtcccaaacgcagtgatattacaaaatgcatggaaagtgagttgcacaatactggcagtggtgtctgtttccccactgcttttgacatcctcacagcaaaaaacggattggataccattagcattgacaatcaagggtctcaatccaacagccatttttctaacaaccctctcaagaaccagcaagaaaaggagctggccactgaatgaagctatcatggcagtcggaatggtgagcattttagccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcaataaaaaatgaagaggaagaacaaacactgaccatactcattagaacaggattgctggtgatttcaggactttttcctgtatcaataccaatcacggcagcagcatggtacctgtgggaagtgaagaaacaacgggccggagtattgtgggatgttccttcacccccacccatgggaaaggctgaactggaagatggagcctacagaatcaagcaaaaagggattcttggatattcccagatcggagctggagtttataaagaaggaacattccatacaatgtggcatgtcacacgtggtgctgtcttaatgcacaaaggaaagaggattgaaccatcatgggcggacgtcaaaaaagatctaatatcatatggaggaggctggaagttggaaggagaatggaaggaaggagaagaagtccaggtgctggcattggagcctggaaaaaatccaagagccgtccaaacaaaacctggtcttttcaaaaccaacgccggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattgaagacaacccagagatcgaagatgacatttttcgaaagagaagactgaccatcatggacctccacccaggagcgggaaagacgaaaagataccttccggccatagtcagagaagctataaaacggggtttgagaacattaatcttggcccccaccagagtagtggcagctgaaatggaggaagctctcagaggacttccaataagataccaaaccccagccatcagagctgagcacactgggcgggaaatagtggatctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggattttcatgacggccactcctccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaggctgagagggttatagaccccagacgttgcatgaaaccagtcatactaacagatggtgaggagcgggtgattctggcaggacccatgccagtgacccactctagtgcagcacaaagaagagggagaatagggagaaatccaaaaaatgaaaatgaccagtacatatatatgggggaacctctggaaaatgatgaagactgtgcacactggaaagaagccaaaatgctcctagataacatcaacacaccagaaggaatcattcccagtatgtttgagccagaacgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaatcaagaacaaccaaatcttggaagaaaatgtggaagttgaaatctggacaaaagaaggggaaaggaagaaattgaaacccagatggctggatgctaggatctattcggacccactggcgctaaaagaattcaaagaatttgcagccggaagaaagtctctgaccctgaacctaatcacagaaatgggtaagcttccaacattcatgactcagaagacaagagacgcactggacaacttagcagtgctgcacacggctgaagcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgtataatcacggctagcatccttctatggtacgctcaaatacagccacactggatagcagcttcaataatactggagttttttctcatagttttgcttattccagaaccagaaaaacagagaacacctcaagacaaccaattgacctacgttgtcatagccatcctcacagtggtggctgcaaccatggcaaacgagatgggtttcctagaaaaaacgaagaaagatcttggactaggaagcattgtaacccagcaacccgagagcaacatcctggacatagatctacgccccgcatcagcatggacgctgtatgccgtggccacaacatttgttacaccaatgctgagacatagcattgagaattcctcagtgaatgtatccctaacagctatagccaaccaagcaacagtgttaatgggtctagggaaaggatggccgttgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcagctggcatcatgaaaaacccaaccgtcgatggaataacagtgattgatctagatccaataccttatgatccaaagtttgaaaagcagttgggacaagtgatgctcctagtcctctgcgtgactcaagtattgatgatgaggactacatgggctctgtgtgaggccttaaccttagctaccgggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaagaacgtaagagaagtgaaaggcctaacaaaaggaggaccaggacacgaagaacccatccccatgtcaacatatgggtggaatctagtgcgtcttcaaagtggagttgacgttttcttcatcccgccagaaaagtgtgacacattgttgtgtgacataggggagtcatcaccaaatcctacagtggaagcaggacgaacactcagagtccttaatttagtagaaaattggttgaacaacaacactcaattttgcataaaagttctcaacccatatatgccctcagttatagaaaaaatggaaacactgcaaaggaaatatggaggagccttagtgagaaatccactctcacggaactccacacatgagatgtactgggtatccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacgaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggctcggagctcgcttcctggagtttgaagccctaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacataagaaattagccgaggccattttcaaactaacgtaccaaaacaaggtggtgcgtgtgcaaagaccaacaccaagaggcacagtaatggacatcatatcaagaagagaccaaagaggtagtgggcaagttggtacctatggactcaatactttcaccaatatggaagcccaattaatcagacagatggagggagaaggagtttttaaaaacattcagcacctgacagtcacagaagaaatcgccgtgcagaactggttagcgagagtggggcgcgaaaggttatcaagaatggccatcagtggagatgattgtgttgtgaaacctttagatgacaggttcgcgagcgctttgacagctctaaatgacatgggaaagattagaaaagacatacaacaatgggaaccttcaagaggatggaacgattggacacaagtgcccttctgttcacaccatttccatgagctaatcatgaaggacggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcggtgccatcacattgggttccaacaagtcgaacaacctggtccatacacgccaaacatgaatggatgacaacggaagacatgctgacagtctggaacagggtgtggattcaagaaaacccatggatggaagaaaaaaccccagtggaatcatgggaggaaatcccatacttggggaaaagagaagaccaatggtgcggctcactgattgggttaacaagcagggccacatgggcaaagaacatccaagcagcaataaatcaagtcagatctcttataggcaatgaggaatacacagattatatgccatccatgaaaagattcagaagagaagaggaagaagcaggagttctgtggtag

SEQ ID NO: 717 - DNA, 10176 bp, Dengue virus
atgaataaccaacggaaaaaggcgaaaaacacgcctttcaatatgctgaaacgcgagagaaaccgcgtgtcgactgtgcaacagctgacgaagagattctcacttggaatgctgcagggacgaggaccattaaaactgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgtaggcatgatcattatgctgattccaacagtaatggcgttccatctgaccacacgcaacggagaaccacatatgatcgtcagtatacaagagaaagggaaaagtctcctgtttaaaacagaggatggcgtgaacatgtgcaccctcatggccatggaccttggtgaattgtgtgaagacacaatcacgtacaagtgtccccttctcagacagaatgagccagaagacatagattgttggtgcaactccacgtccacgtgggtaacctatgggacttgtaccaccacgggagaacatagaagagaaaaaagatcagtggcactcgttccacatgtgggaatgggactggaaacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcttgctgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcaccttcaaaaatccccatgcgaagaaacaggatgttgttgttttaggatcccaagaaggggccatgcatacagcactcacaggagccacggaaatccaaatgtcgtcaggaaacttactcttcactggacatctcaagtgcaggctgagaatggacaagctacagctcaaaggaatgtcatactctatgtgcacaggaaagtttaaagttgtgaaggaaatagcagaaacacaacatggaacaatagtcatcagagtgcaatatgaaggggacggctctccatgtaaagtcccttttgagataatggatttggaaaaaagatatgtcttaggccgcctgatcacagtcaacccagttgtgacagaaaaagatagcccagtcaacatagaagcagaacctccattcggagacagctacatcatcataggagtagagccgggacaactgaagctcaactggttcaagaaaggaagttctatcggccagatgtttgagacaacaatgaggggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtgttggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagactggagaacctaatgtggaaacagataacaccagaattgaatcacattctagcagaaaatgaggtgaagttaactattatgacaggagacatcaaaggaatcatgcaggcaggaaaacgatctctgcggcctcagcccactgagctaaagtactcatggaaaacatggggcaaagcaaaaatgctctccacagagtctcataaccaaacttttctcattgatggccccgaaacagcagaatgccccaacacaaatagagcttggaactcattggaggttgaagactacggttttggagtgttcaccaccaatatatggctaaaattgaaagaaaaacaggatgcattctgcgactcaaaactcatgtcagcggccgtaaaagacaacagagccgtccatgccgacatgggttattggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtggtgactgaggactgcggaaatagaggaccctctttgagaacaactactgcctctggaaaactcataacagaatggtgctgccgatcttgcacattgccacccctaagatatagaggtgaggttgggtgctggtacgggatggaaatcagaccattgaaagagaaagaagaaaatttggttaactccttggtcacagccggacaagggcaggttgacaatttttcactaggagtcttgggaatggcattgttcctggaggaaatgcttaggacccgagtaggaacgaaacatgcaatactactagttgcagtttcttttgtgacattgatcacagggaacatgtcctttaaagacctaggaagagtggtggttatggtaggggccaccatgacggatgacataggtatgggcgtaacttatcttgccctactagcagcctttaaagtcagaccaacttttgcagctggactactcttgagaaagctgacctccaaggaattgatgatgaccaccataggaattgtactcctctctcaaagcactataccagaaaccatccttgaattgactgatgcgttagccttaggcatgatggtcctcaaaatagtaagagacatggaaaagtatcaattggcagtgactatcatggctatcttgtgcgtcccaaacgcagtgatattacaaaatgcatggaaagtgagttgcacaatactagcagtggtgtccgtttccccactgcttttgacatcctcacagcaaaaaacggattggataccattagcattgacaatcaagggtctcaatccaacagccatctttctaacaactctctcaagaaccaacaagaaaaggagctggccactaaatgaggccatcatggcagtcggaatggtgagcattttagccagttctctcctaaaaaatgatatccctatgacaggaccactagtggctggagggctcctcactgtatgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtactgtgggatgttccttcacccccacccatgggaaaggctgaactggaagatggagcctacagaatcaagcaaaaagggattcttggatattcccagatcggagctggagtttataaagaaggaacattccatacgatgtggcatgtcacacgtggcgctgtcctaatgcataaaggaaagaggattgaaccatcatgggcggacgtcaaaaaagatctaatatcatatggaggaggctggaagctagaaggagaatggaaggaaggagaagaagtccaggtgctggcattggagcctgggaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggcaatggtgttgttacaaggagtggagcatatgtgagtgctatagcccaaactgaaaaaagcattgaagacaacccagacatcgaagatgacattttccgaaagagaagactgaccatcatggacctccacccaggagcgggaaagacgaaaagataccttccggccatagtcagagaagccataaaacggggtttgagaacattaatcttggcccccaccagagttgtggcagctgaaatggaggaggctctcagaggacttccaataagataccaaaccccagccatcagagctgagcacacagggcgggaaattgtggatctaatgtgtcatgccacatttaccatgaggctgctatcaccagttagagtgccaaactacaacctgattatcatggatgaagcccatttcacagacccagcaagtatagcagctagaggatacatctcaactcgagtggagatgggtgaagcagctgggattttcatgacagccactcccccgggaagcagagatccatttcctcagagcaatgcaccgatcatagatgaagaaagagaaatccctgaacgttcatggaattctggacacgagtgggttacggattttaaagggaaaactgtttggttcgttccaagcataaaagcaggaaatgatatagcagcttgcctgagaaaaaatggaaagaaagtaatacaacttagtaggaagacttttgattctgagtatgccaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacattaacacaccagaaggaatcattcccagtatgtttgaaccagagcgtgaaaaagtggatgccattgatggcgaataccgcttgagaggagaggcaaggaaaacctttgtggacttaatgagaagaggagacctaccagtctggctggcctacaaagtggcagctgaaggcatcaactatgcagacagaaggtggtgttttgatggaatcaagaacaaccaaatcctggaagagaatgtggaagttgaaatttggacaaaagaaggggaaaggaagaaattgaaacccagatggctggatgctaggatctactctgacccactggcgctaaaagaattcaaagaatttgcagccggaagaaagtctctgaccctgaacctaattacagaaatgggtaggcttccaacattcatgactcagaagacaagagacgcactggacaacttagcagtgctgcacacggccgaagcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgcatagtcacggctagcatccttttatggtacgcacaaatacagccacactggatagcagcttcaataatactggagttttttctcatagttttgcttattccagaaccagaaaaacagagaacaccccaagacaaccaattaacctatgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgccccgcatcagcatggacgctgtatgccgtggctacaacatttgttacaccaatgctgagacatagtattgagaattcctcagtgaatgtatccctaacagctatagctaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccattatagggccaggacttcaagcaaaagcaaccagagaagctcagaaaagagcagcggcgggcatcatgaaaaacccaaccgttgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttggctaccgggcccatctccacactgtgggaaggaaatccaggaaggttctggaacactaccattgcggtgtcaatggccaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcaaagtggagttgacgttttcttcatcccgccagaaaagtgtgacacattgttgtgtgacataggggagtcatcaccaaatcctacagtggaagcaggacgaacactcagagtccttaatttagtagaaaattggttgaacaacaacactcaattttgcataaaagttctcaacccatatatgccctcagttatagaaaaaatggaaacactgcaaaggaaatatggaggagccttagtgagaaatccactctcacggaactccacacatgagatgtactgggtatccaatgcttccgggaacatagtgtcatcagtgaacatgatttcaaggatgttgatcaacagattcacaatgagacacaagaaagccacttacgagccggatgttgacctcggaagcggaacccgtaacattggaattgaaagtgagataccaaatctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacgaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagcaggttttgggagctggttgacaaggaaaggaatctccatcttgaaggaaagtgtgaaacatgtgtgtacaacatgatgggaaaaagagaaaagaagctaggggaattcggtaaggcaaaaggcagcagagccatatggtacatgtggctcggagctcgcttcctggagtttgaagccctaggattcctaaatgaagatcactggttctccagagagaactccttgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacataagaaattagccgaggccattttcaaactaacgtaccaaaacaaggtggtgcgtgtgcaaagaccaacaccaagaggcacagtaatggacatcatatcaagaagagaccaaagaggtagtgggcaagttggtacctatggactcaatactttcaccaatatggaagcccaattaatcagacagatggagggagaaggagtttttaaaaacattcagcacctgacagtcacagaagaaatcgccgtgcagaactggttagcgagagtggggcgcgaaaggttatcaagaatggccatcagtggagatgattgtgttgtgaaacctttagatgacaggttcgcgagcgctttgacagctctaaatgacatgggaaagattagaaaagacatacaacaatgggaaccttcaagaggatggaacgattggacacaagtgcccttctgttcacaccatttccatgagctaatcatgaaggacggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggttggcggcaaatgccatttgctcggcagtgccatcacattgggttccaacaagtcgaacaacctggtccatacacgccaaacatgaatggatgacaacggaagacatgctgacagtctggaatagggtgtggattcaagaaaacccatggatggaagacaaaaccccagtggaatcatgggaggaaatcccgtacttggggaaaagagaagaccaatggtgtggctcactgattgggttgacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 718 - DNA, 10176 bp, Dengue virus
atgaataaccaacggaaaaaggcgagaaacacgcctttcaatatgctgaaacgcgagagaaaccgcgtgtcaactgtacaacagctgacaaagagattctcacttggaatgctgcagggacgaggaccactaaaattgttcatggccctggtggcattccttcgtttcctaactatcccaccaacagcagggatattgaaaagatggggaacaatcaaaaaatcaaaggctattaatgttctaagaggcttcaggaaagagattggaaggatgctgaatatcttaaacaggagacgtagaactgcaggcatgatcatcatgctgattccaacagtgatggcgtttcatctgaccacacgcaacggagaaccacacatgatcgtcagtagacaagaaaaagggaaaagccttctgtttaagacaaaggatggcacgaacatgtgcactcttatggccatggaccttggtgagttgtgtgaagacacaatcacgtataagtgtccttttctcaagcagaacgaaccagaagacatagattgttggtgcaactccacgtccacatgggtaacttacgggacatgtaccaccacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggttttaccataatggccgcaatcctggcatacactataggaacgacgcatttccaaagagtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaataaaccaacattggactttgaactgataaaaacagaagccaaacaacccgccaccttaaggaagtactgtatagaggccaaactgaccaacacgacaacagactcgcgttgcccaacacaaggggaacccaccctgaatgaagagcaggacaaaaggtttgtctgcaaacattccatggtagacagaggatggggaaatggatgtggattgtttggaaaaggaggcatcgtgacctgtgctatgttcacatgcaaaaagaacatggaaggaaaaattgtgcagccagaaaacctggaatacactgtcgtgataacacctcactcaggggaagaacatgcagtcggaaatgacacaggaaaacatggtaaagaagtcaagataacaccacagagctccatcacagaggcggaactgacaggctatggcactgtaacgatggagtgctctccaagaacgggcctcgacttcaatgagatggtgttgctgcaaatggaagacaaagcttggctggtgcacagacaatggttcctagacctaccgttgccatggctgcccggagcggacacacaaggatcaaattggatacagaaagagacattggtcaccttcaaaaatccccatgcgaaaaaacaggatgttgttgtcctaggatcccaagagggggccatgcatacagcactcacaggggccacggaaatccaaatgtcatcaggaaacctgctgttcacaggacatctcaaatgcaggctgagaatggacaaattacaacttaaagggatgtcatactccatgtgcacaggaaaatttaagattgtgaaggaaatagcagaaacacaacatggaacaatagtcattagagtacaatatgaaggagacggctctccatgcaagatcccctttgagataatggatctagaaaaaagacatgttttgggccgcctgatcacagtcaatccaattgtaacagaaaaggacagtccagtcaacatagaagcagaacctccattcggagacagctacatcatcataggagtagaaccaggacaattaaagctggactggttcaagaaaggaagttccatcggtcaaatgtttgagacaacaatgaggggagcgaaaagaatggccatcttgggcgatacagcctgggattttggatctctgggaggagtgtttacatcaataggaaaagctctccaccaggttttcggagcaatctacggggctgcattcagtggggtttcatggactatgaagatcctcataggagttatcatcacatggataggaatgaactcacgcagcacatcactgtctgtgtcactggtattagtgggaatcgtgacactgtacttgggagttatggtgcaagccgatagtggttgcgttgtgagctggaagaacaaagaactaaaatgtggcagtggaatattcgtcacagataacgtgcatacatggacagaacaatacaagttccaaccagaatccccttcaaaactggcttcagccattcagaaagctcacgaagaaggcatctgtggaatccgctcagtaacaagactggaaaatcttatgtggaaacagataacatcagaattgaatcatattctatcagaaaatgaagtgaaactgaccatcatgacaggagacatcaaaggaatcatgcaggtaggaaaacgatctctgcggcctcaacctactgagttgaggtattcatggaaaacatggggtaaagcgaaaatgctctccacagaactccacaatcagaccttcctcattgatggtcccgaaacagcagaatgccccaacacaaacagagcttggaattcactagaagttgaggactatggctttggagtattcactaccaatatatggctaagattgagagaaaagcaagatgcattttgtgactcaaagctcatgtcagcggccataaaggacaacagagccgtccatgctgatatgggttattggatagaaagcgcactcaatgatacatggaagatagagaaagcttctttcattgaagtcaaaagttgccactggccaaagtcacacactctatggagtaatggagtgctagaaagcgagatggtaattccaaagaatatcgctggaccagtgtcacaacataataacagaccaggctatcacacacaaacagcaggaccttggcatctaggcaagcttgagatggactttgatttctgcgaagggaccacagtggtggtaaccgaagaatgtggaaacagagggccttctttaagaacaaccactgcctcaggaaaactcataacggaatggtgttgtcgatcttgcacactaccaccattaagatacagaggtgaggatggatgctggtacgggatggaaatcagaccattgaaagagaaagaagaaaatctggtcagctccctggtcacagccggacatgggcagattgataatttctcattaggaatcttgggaatggcgctgttccttgaagaaatgctcaggactcgagtaggaacgaaacatgcaatactactagttgcagtttctttcctaacgttaatcacagggaacatgtcttttagagacctgggaagagtgatggttatggtgggtgccaccatgacagatgacataggcatgggtgtgacttatcttgccctactagcagccttcaaagtcagaccaacctttgcagctggactgctcttgagaaaactgacctccaaggaattgatgatgaccaccataggaatcgttctcctctcccagagtagtataccagagactattcttgagctgaccgatgcgttagccttaggcatgatggtcctcaagatggtgagaaacatggaaaaatatcagctggcagtgactatcatggctattttgtgtgtcccaaatgctgtgatattacagaacgcatggaaagtgagttgcacaacactggcagtggtgtctgtttcccccctgctcttgacatcctcacagcagaaagcggactggatacctttagcgttgacgatcaaaggcctgaatcccacagccatttttctaacaaccctcacaagaaccagcaagaaaaggagctggcctttaaacgaggccatcatggcggttgggatggtgagtatcttggccagctctctcttgaagaacgacatccccatgacaggaccattagtggctggagggcttctcactgtgtgctacgtattaaccgggcggtcagccgatctggaactagagagagctaccgatgtcaaatgggatgatcaggcagagatatcaggtagcagtccaattctgtcaataacaatatcagaagatggcagcatgtcaataaagaatgaagaggaagagcaaacactgactatactcattagaacaggactgcttgtgatctcaggactctttccggtatcaataccaattacagcagcagcatggtacctgtgggaagtaaagaaacaacgggctggagtgttgtgggatgtcccctcaccaccacccgtgggaagggctgaattggaagatggagcctacagaatcaagcaaaaaggaattcttggatattcccagatcggagctggagtttacaaagaaggaacatttcacaccatgtggcacgtcacacgtggcgcagtcctaatgcataaggggaagaggattgaaccatcatgggcggacgtcaagaaagacttaatatcatatggaggaggttggaagctagaaggagaatggaaagaaggagaagaagtccaggtcttggcattggagcctgggaaaaatccaagagccgtccaaacaaaacctggcctttttagaaccaatactggaaccataggcgccgtatctctggacttttcccctgggacgtcaggatctccaatcgttgacaaaaaaggaaaagttgtaggtctctatggcaacggtgttgttacaaggggtggagcatatgtgagtgccatagctcagactgaaaaaggcattgaagacaatccagagattgaagatgacatctttcgaaagagaagattgactatcatggatctccacccaggagcaggaaagacaaagagatacctcccggccatagttagagaggccataaaaagaggcttgagaacactaatcctagcccccactagagtcgtggcagctgaaatggaggaagcccttagaggacttccaataagataccaaactccagctattagggctgagcacacagggcgggagatcgtggacttaatgtgtcacgccacatttaccatgaggctgctatcaccaatcagggtgccaaattacaacctgatcatcatggacgaagcccattttacagatccagcaagcatagcagctaggggatacatctcaactcgagtggagatgggtgaggcagctggaatttttatgacagccactcctccgggcagcagagatccatttcctcagagtaatgcaccaattatggacgaagaaagagaaattccggaacgttcatggaactccgggcacgagtgggtcacagattttaaaggaaagactgtctggtttgttccaagcataaaaaccggaaatgacatagcagcctgtctgagaaagaatggaaagagggtgatacaactcagtaggaagacctttgattctgaatacgtcaagactagaaccaatgactgggatttcgtggttacaactgacatttcggaaatgggtgccaactttaaagctgagagggttatagaccccagacgctgcatgaaaccagtcatactgacagacggcgaagagcgggtgattctagcaggacccatgccagtgacccactccagtgcagcacaaagaagagggagaataggaaggaatccaaggaatgaaaatgatcaatacatatatatgggagaacccctggaaaatgatgaagactgtgcgcactggaaggaagctaagatgctcctagataacatcaacacacctgaaggaatcattcccagcatgttcgagccagagcgtgaaaaggtggatgccattgacggtgaatatcgcttgagaggagaagcacggaaaacttttgtggacctaatgagaagaggagacctaccagtctggttggcttataaagtggcatctgaaggtatcaactacgcagacagaagatggtgttttgacggaaccagaaacaatcaaatcttggaagaaaatgtggaagtggaaatttggacaaaggaaggggaaaggaagaaattgaaacctagatggttagatgctaggatctactccgacccactggcgctaaaagaattcaaggaattcgcagccggaagaaagtccctaaccctgaacctaatcacagagatgggcagactcccaacttttatgactcagaaggccagagatgcactagacaacttggcggtgctgcacacggctgaagcgggtggaaaggcatacaatcatgctctcagtgaactaccggagaccctggagacattgcttttgctgacactgttggccacagtcacgggaggaatctttttattcctgatgagcggaaggggtatagggaagatgaccctgggaatgtgctgcataatcacggccagcatcctcttatggtatgcgcaaatacaaccacattggatagcagcttcaataatattggagttctttctcatagtcttgctcattccagaaccagaaaagcagaggacaccccaggataaccaattgacttatgtcatcatagccatcctcacagtggtggccgcaaccatggcaaacgaaatgggttttctagaaaaaacaaagaaagacctcggactgggacacattgcaactcagcaacctgagagcaacattctggatatagatctacgtcctgcatcagcatggacgttgtatgccgtggctacaacatttatcacaccaatgttgagacatagcattgaaaattcctcagtaaatgtgtccctaacagccatagctaaccaagccacagtgctaatgggtctcgggaaaggatggccattgtcaaagatggacattggagtccccctccttgccattgggtgttactcacaagtcaaccctataaccctcacagcggctcttcttttattggtagcacattatgccatcattggaccgggacttcaagccaaagcaaccagagaagcccagaaaagagcagcagcgggcatcatgaaaaacccaactgtggatggaataacagtgatagatctagatccaataccctatgatccaaagtttgaaaagcagttgggacaagtaatgctcctagtcctttgtgtgacccaagtgctgatgatgaggactacgtgggctttgtgtgaagccttaactctagcaaccggacccgtgtctacattgtgggaaggaaatccagggagattctggaacacaaccattgcagtgtcaatggcaaacatctttagagggagttaccttgctggagctggacttctcttttctatcatgaagaacacaactagcacgagaagaggaactggcaacatgggagaaacgctaggagagaaatggaaaaacagactgaacgcattggggaaaagtgaattccagatctacaaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggtttgaagaatgtaagagaagttaaaggcttaacaaaaggaggaccaggacacgaagaacctatccctatgtcaacatatgggtggaatctagtacgcttacagagcggagttgatgttttttttgttccaccagagaagtgtgacacattgttgtgtgacataggagaatcatcaccaaatcccacggtagaggcgggacgaacactcagagtccttaacctagtggaaaattggctgaacaataacacccaattttgcgtaaaggttcttaacccatacatgccctcagtcattgaaaggatggaaaccttacaacggaaatacggaggagccctggtgagaaatccactctcacggaattccacacatgaaatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaacattggaattgaaagtgagacaccgaacctagacataattgggaaaagaatagaaaaaataaaacaggagcatgaaacgtcatggcactatgaccaagaccacccatacaaaacatgggcttaccatggtagctatgaaacaaaacagacgggatcagcatcatccatggtgaacggagtagtcagactgctgacaaagccctgggacgttattccaatggtgacacagatggcaatgacagacacaactcctttcggacaacagcgtgtcttcaaagagaaggtggatacgagaactcaagaaccaaaagaaggcacaaaaaaactaatgaaaatcacagcagaatggctctggaaagaactaggaaagaaaaagacacctagaatgtgcaccagagaagaattcacaaaaaaggtaagaagcaatgcagccttgggggccatatttaccgatgagaacaagtggaagtcggcgcgtgaggctgttgaagacaataggttttgggagctggttgacaaggaaagaaacctccatcttgaaggaaaatgtgaaacatgtgtatacaacatgatgggaaaaagagagaaaaaactaggagagtttggtaaagcaaaaggcagcagagccatatggtacatgtggctcggagcacgcttcttagagtttgaagccctaggatttttgaatgaagaccattggttctccagagagaactccctgagtggagtggaaggagaagggctgcataaactaggttacatcttaagagaggtgagcaagaaagaaggaggagcaatgtatgccgatgataccgcaggctgggacacaagaatcacaatagaggatttaaaaaatgaagaaatgataacgaaccacatggcaggagaacacaagaaacttgccgaggccattttcaaattgacgtaccaaaacaaggtggtgcgtgtgcaaagaccaacaccaagaggcacggtaatggacatcatatcgagaagagaccaaaggggtagtggacaagttgtcacctatggcctcaacactttcaccaacatggaagcgcaactaattaggcaaatggagggggaaggagtcttcaaaagcatccagcacttgacagcctcagaagaaatcgctgtgcaagattggctagtaagagtagggcgtgaaaggctgtcaagaatggccatcagtggagatgattgtgttgtgaaacctttagatgacagatttgcaaaagctctaacagctctaaatgacatgggaaaggttaggaaggatatacagcaatgggaaccctcaagaggatggaacgactggacacaggtgcccttctgctcacaccattttcacgagttaatcatgaaagatggccgcacacttgtagttccatgcagaaatcaagatgaattgatcggcagagcccgaatttcccagggagctgggtggtctttacgggagacggcctgtttgggaaagtcttacgcccaaatgtggagcctgatgtacttccatagacgtgatctcaggttagcggcaaatgccatttgctcggcagtcccgtcacactgggttccaacaagccggacaacctggtccatacacgccagccatgaatggatgacgacggaagacatgttgacagtttggaacagagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagatttagaagggaagaggaagaggcaggagttttgtggtag

SEQ ID NO: 719 - DNA, 10176 bp, Dengue virus
atgaataaccaacggaaaaaggcgagaaacacgcctttcaatatgctgaaacgcgagagaaaccgcgtgtcaactgtacaacagctgacaaagagattctcacttggaatgctgcagggacgaggaccactaaaattgttcatggccctggtggcattccttcgtttcctaactatcccaccaacagcagggatattgaaaagatggggaacaatcaaaaaatcaaaggctatcaatgttctaagaggcttcaggaaagagattggaaggatgctgaatatcttaaacaggagacgtagaactgcaggcatgatcatcatgctgattccaacagtgatggcgtttcatctgaccacacgcaacggagaaccacacatgatcgtcagtagacaagaaaaagggaaaagccttctgtttaagacaaaggatggcacgaacatgtgcactcttatggccatggaccttggtgagttgtgtgaagacacaatcacgtataagtgtccttttctcaagcagaacgaaccagaagacatagattgttggtgcaactccacgtccacatgggtaacttacgggacatgtaccaccacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggttttaccataatggccgcaatcctggcatacactataggaacgacgcatttccaaagagtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaataaaccaacattggactttgaactgataaaaacagaagccaaacaacccgccaccttaaggaagtactgtatagaggccaaactgaccaacacgacaacagactcgcgttgcccaacacaaggggaacccaccctgaatgaagagcaggacaaaaggtttgtctgcaaacattccatggtagacagaggatggggaaatggatgtggattgtttggaaaaggaggcatcgtgacctgtgctatgttcacatgcaaaaagaacatggaaggaaaaattgtgcagccagaaaacctggaatacactgtcgtgataacacctcactcaggggaagaacatgcagtcggaaatgacacaggaaaacatggtaaagaagtcaagataacaccacagagctccatcacagaggcggaactgacaggctatggcactgtaacgatggagtgctctccaagaacgggcctcgacttcaatgagatggtgttgctgcaaatggaagacaaagcttggctggtgcacagacaatggttcctagacctaccgttgccatggctgcccggagcggacacacaaggatcaaattggatacagaaagagacattggtcaccttcaaaaatccccatgcgaaaaaacaggatgttgttgtcctaggatcccaagagggggccatgcatacagcactcacaggggccacggaaatccaaatgtcatcaggaaacctgctgttcacaggacatctcaaatgcaggctgagaatggacaaattacaacttaaagggatgtcatactccatgtgcacaggaaaatttaagattgtgaaggaaatagcagaaacacaacatggaacaatagtcattagagtacaatatgaaggagacggctctccatgcaagatcccctttgagataatggatctagaaaaaagacatgttttgggccgcctgatcacagtcaatccaattgtaacagaaaaggacagtccagtcaacatagaagcagaacctccattcggagacagctacatcatcataggagcagaaccaggacaattaaagctggactggttcaagaaaggaagttccatcggtcaaatgtttgagacaacaatgaggggagcgaaaagaatggccatcttgggcgatacagcctgggattttggatctctgggaggagtgtttacatcaataggaaaagctctccaccaggttttcggagcaatctacggggctgcattcagtggggtttcatggactatgaagatcctcataggagttatcatcacatggataggaatgaactcacgcagcacatcactgtctgtgtcactggtattagtgggaatcgtgacactgtacttgggagttatggtgcaagccgatagtggttgcgttgtgagctggaagaacaaagaactaaaatgtggcagtggaatattcgtcacagataacgtgcatacatggacagaacaatacaagttccaaccagaatccccttcaaaactggcttcagccattcagaaagctcacgaagaaggcatctgtggaatccgctcagtaacaagactggaaaatcttatgtggaaacagataacatcagaattgaatcatattctatcagaaaatgaagtgaaactgaccatcatgacaggagacatcaaaggaatcatgcaggtaggaaaacgatctctgcggcctcagcctactgagttgaggtattcatggaaaacatggggtaaagcgaaaatgctctccacagaactccacaatcagaccttcctcattgatggtcccgaaacagcagaatgccccaacacaaacagagcttggaattcactagaagttgaggactatggctttggagtattcactaccaatatatggctaagattgagagaaaagcaagatgcattttgtgactcaaagctcatgtcagcggccataaaggacaacagagccgtccatgctgatatgggttattggatagaaagcgcactcaatgatacatggaagatagagaaagcttctttcattgaagtcaaaagttgccactggccaaagtcacacactctatggagtaatggagtgctagaaagcgagatggtaattccaaagaatatcgctggaccagtgtcacaacataataacagaccaggctatcacactcaaacagcaggaccttggcatctaggcaagcttgagatggactttgatttctgcgaagggaccacagtggtggtaaccgaagaatgtggaaacagagggccttctttaagaacaaccactgcctcaggaaaactcataacggaatggtgttgtcgatcttgcacactaccaccattaagatacagaggtgaggatggatgctggtacgggatggaaatcagaccattgaaagagaaagaagaaaatctggtcagctctctggtcacagccggacatgggcagattgataatttctcattaggaatcttgggaatggcgctgttccttgaagaaatgctcaggactcgagtaggaacgaaacatgcaatactactagttgcagtttctttcctaacgttaatcacagggaacatgtcttttagagacctgggaagagtgatggttatggtgggtgccaccatgacagatgacataggcatgggtgtgacttatcttgccctactagcagccttcaaagtcagaccaacctttgcagctggactgctcttgagaaaactgacctccaaggaattgatgatgaccaccataggaatcgttctcctctcccagagtagtataccagagactattcttgagctgaccgatgcgttagccttaggcatgatggtcctcaagatggtgagaaacatggaaaaatatcagctggcagtgactatcatggctattttgtgtgtcccaaatgctgtgatattacagaacgcatggaaagtgagttgcacaacactggcagtggtgtctgtttcccccctgctcttgacatcctcacagcagaaagcggactggatacctttagcgttgacgatcaaaggcctgaatcccacagccatttttctaacaaccctcacaagaaccagcaagaaaaggagctggcctttaaacgaggccatcatggcggttgggatggtgagtattttggccagctctctcttgaagaacgacatccccatgacaggaccattagtggctggagggcttctcactgtgtgctacgtattaaccgggcggtcagccgatctggaactagagagagctaccgatgtcaaatgggatgatcaggcagagatatcaggtagcagtccaattctgtcaataacaatatcagaagatggcagcatgtcaataaagaatgaagaggaagagcaaacactgactatactcattagaacaggactgcttgtgatctcaggactctttccggtatcaataccaattacagcagcagcatggtacctgtgggaagtaaagaaacaacgggctggagtgttgtgggatgtcccctcaccaccacccgtgggaagggctgaattggaagatggagcctacagaatcaagcaaaaaggaattcttggatattcccagatcggagctggagtttacaaagaaggaacatttcacaccatgtggcacgtcacacgtggcgcagtcctaatgcataaggggaagaggattgaaccatcatgggcggacgtcaagaaagacttaatatcatatggaggaggttggaagctagaaggagaatggaaagaaggagaagaagtccaggtcttggcattggagcctgggaaaaatccaagagccgtccaaacaaaacctggcctttttagaaccaatactggaaccataggcgccgtatccctggacttttcccctgggacgtcaggatctccaatcgttgacaaaaaaggaaaagttgtaggtctctatggcaacggtgttgttacaaggggtggagcatatgtgagtgccatagctcagactgaaaaaggcattgaagacaatccagagattgaagatgacatctttcgaaagagaagattgactatcatggatctccacccaggagcaggaaagacaaagagatacctcccggccatagttagagaggccataaaaagaggcttgagaacactaatcctagcccccactagagtcgtggcagctgaaatggaggaagcccttagaggacttccaataagataccaaactccagctattagggctgagcacacagggcgggagatcgtggacttaatgtgtcacgccacatttaccatgaggctgctatcaccaatcagggtgccaaattacaacctgatcatcatggacgaagcccattttacagatccagcaagcatagcagctaggggatacatctcaactcgagtggagatgggtgaggcagctggaatttttatgacagccactcctccgggcagcagagatccatttcctcagagtaatgcaccaattatggacgaagaaagagaaattccggaacgttcatggaactccgggcacgagtgggtcacagattttaaaggaaagactgtctggtttgttccaagcataaaaaccggaaatgacatagcagcctgtctgagaaagaatggaaagagggtgatacaactcagtaggaagacctttgattctgaatacgtcaagactagaaccaatgactgggatttcgtggttacaactgacatttcggaaatgggtgccaactttaaagctgagagggttatagaccccagacgctgcatgaaaccagtcatactgacagacggcgaagagcgggtgattctagcaggacccatgccagtgacccactccagtgcagcacaaagaagagggagaataggaaggaatccaaggaatgaaaatgatcaatacatatatatgggagaacccctggaaaatgatgaagactgtgcgcactggaaggaagctaagatgctcctagataacatcaacacacctgaaggaatcattcccagcatgttcgagccagagcgtgaaaaggtggatgccattgacggtgaatatcgtttgagaggagaagcacggaaaacttttgtggacctaatgagaagaggagacctaccagtctggttggcttataaagtggcagctgaaggtatcaactacgcagacagaagatggtgttttgacggaaccagaaataatcaaatcttggaagaaaatgtggaagtggaaatctggacaaaggaaggggaaaggaaaaaattgaaacctagatggttagatgctaggatctactccgacccactggcgctaaaagaattcaaggaattcgcagccggaagaaagtccttaaccctgaacctaatcacagagatgggcagactcccaacttttatgactcagaaggccagagatgcactagacaacttagcggtgctgcacacggctgaagcgggtggaaaagcatacaatcatgccctcagtgaactaccggagaccctggagacactgcttttgctgacactgttggccacagtcacgggaggaatctttctattcctgatgagcggaaggggtatagggaagatgaccctgggaatgtgctgcataatcacggccagcatactcttatggtatgcacaaatacaaccacattggatagcagcttcaataatattggagttctttctcatagtattgctcatcccagaaccagaaaagcagaggacaccccaggataatcaattgacttatgtcattatagccatcctcacagtggtggccgcaaccatggcaaacgaaatgggttttctagaaaaaacaaagaaagacctcggactgggacacattgcaactcagcaacctgagagcaacattctggatatagatctacgtcctgcatcagcatggacgttgtatgccgtggcaacaacatttatcacaccaatgttgagacatagcattgaaaattcctcagtaaatgtgtccctaacagccatagctaaccaggccacagtgctaatgggtctcggaaaaggatggccattgtcaaagatggacattggagttcccctccttgccattgggtgttactcacaagtcaaccccataactctcacagcggctcttcttatgttagtagcacattatgccatcataggaccgggacttcaagccaaagcaaccagagaagctcagaaaagggcagcggcgggcatcatgaaaaacccaactgtggatggaataacagtgatagatctagatccaataccctatgatccaaagtttgaaaagcagttgggacaagtaatgctcctagtcctttgtgtgacccaagtgctgatgatgaggactacgtgggctttgtgtgaagccttaactctagcaaccggacccgtgtccacattgtgggaaggaaatccagggagattctggaacacaaccattgcagtgtcaatggcaaacatctttagagggagttaccttgctggagctggacttctcttttctatcatgaagaacacaactagcacgagaagaggaactggcaacatgggagaaacgctaggagagaaatggaaaaacagactgaacgcattggggaaaagtgaattccagatctacaaaaagagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggtttgaagaatgtaagagaagttaaaggcttaacaaaaggaggaccaggacacgaagaacctatccctatgtcaacatatgggtggaatctagtacgcttacagagcggagttgatgttttttttgttccaccagagaagtgtgacacattgttgtgtgacataggagaatcatcaccaaatcccacggtagaggcgggacgaacactcagagtccttaacctagtggaaaattggctgaacaataacacccaattttgcgtaaaggttcttaacccatacatgccctcagtcattgaaaggatggaaaccttacaacggaaatacggaggagccctggtgagaaatccactctcacggaattccacacatgaaatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaacattggaattgaaagtgagacaccgaacctagacataattgggaaaagaatagaaaaaataaaacaggagcatgaaacgtcatggcactatgaccaagaccacccatacaaaacatgggcttaccatggtagctatgaaacaaaacagacgggatcagcatcatccatggtgaacggagtagtcagactgctgacaaagccctgggacgttattccaatggtgacacagatggcaatgacagacacaactcctttcggacaacagcgtgtcttcaaagagaaggtggatacgagaactcaagaaccaaaagaaggcacaaaaaaactaatgaaaatcacagcagaatggctctggaaagaactaggaaagaaaaagacacctagaatgtgcaccagagaagaattcacaaaaaaggtaagaagcaatgcagccttgggggccatatttaccgatgagaacaagtggaagtcggcgcgtgaggctgttgaagacaataggttttgggagctggttgacaaggaaagaaacctccatcttgaaggaaaatgtgaaacatgtgtatacaacatgatgggaaaaagagagaaaaaactaggagagtttggtaaagcaaaaggcagcagagccatatggtacatgtggctcggagcacgcttcttagagtttgaagccctaggatttttgaatgaagaccattggttctccagagagaactccctgagtggagtggaaggagaagggctgcataaactaggttacatcttaagagaggtgagcaagaaagaaggaggagcaatgtatgccgatgataccgcaggctgggacacaagaatcacaatagaggatttaaaaaatgaagaaatgataacgaaccacatggcaggagaacacaagaaacttgccgaggccattttcaaattgacgtaccaaaacaaggtggtgcgtgtgcaaagaccaacaccaagaggcacggtaatggacatcatatcgagaagagaccaaaggggtagtggacaagttgtcacctatggcctcaacactttcaccaacatggaagcgcaactaattaggcaaatggagggggaaggagtcttcaaaagcatccagcacttgacagcctcagaagaaatcgctgtgcaagattggctagtaagagtagggcgtgaaaggctgtcaagaatggccatcagtggagatgattgtgttgtgaaacctttagatgacagatttgcaaaagctctaacagctctaaatgacatgggaaaggttaggaaggatatacagcaatgggagccctcaagaggatggaacgactggacacaggtgcccttctgctcacaccattttcacgagttaatcatgaaagatggccgcacacttgtagttccatgcagaaatcaagatgaattgatcggcagagcccgaatttcccagggagctgggtggtctttacgggagacggcctgtttgggaaagtcttacgcccaaatgtggagcctgatgtacttccatagacgtgatctcaggttggcggcaaatgccatttgctcggcagtcccgtcacactgggttccaacaagccggacaacctggtccatacacgccagccatgaatggatgacgacggaagacatgttgacagtttggaacagagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagatttagaagggaagaggaagaggtaggagttttgtggtag

SEQ ID NO: 720 - DNA, 10176 bp, Dengue virus
atgaataaccaacggaaaaaggcgaaaaacacgcctttcaatatgctgaaacgcgagagaaaccgcgtgtcgactgtgcaacagctgacgaagagattctcacttggaatgctgcagggacgaggaccattaaaactgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgtaggcatgatcattatgctgattccaacagtaatggcgttccatctgaccacacgcaacggagaaccacatatgatcgtcagtatacaagagaaagggaaaagtctcctgtttaaaacagaggatggcgtgaacatgtgcaccctcatggccatggaccttggtgaattgtgtgaagacacaatcacgtacaagtgtccccttctcagacagaatgagccagaagacatagattgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcttgctgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcccgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtagtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttactcttcactggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgtaaagtcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagttctatcggccagatgtttgagacaacaatgaggggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagttattatcacatggataggaatgaactcacgcagcacctcactgtctgtgtcactagtgttggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagactggagaacctaatgtggaaacagataacaccagaattgaatcacattctagcagaaaatgaggtgaagttaactattatgacaggagacatcaaaggaatcatgcaggcaggaaaacgatctctgcggcctcagcccactgagctaaagtattcatggaaaacatggggcaaagcaaaaatgctctccacagagtctcataaccaaacttttctcattgatggccccgaaacagcagaatgccccaacacaaacagagcttggaactcattggaggttgaagactacggttttggagtgttcaccaccaatatatggctaaaattgaaagaaaaacaggatgcattctgcgactcaaaactcatgtcagcggccataaaagacaacagagccgtccatgccgacatgggttattggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtggtgactgaggactgcggaaatagaggaccctctttgagaacaactactgcctctggaaaactcataacagaatggtgctgccgatcttgcacattaccacccctaagatatagaggtgaggatgggtgctggtacgggatggaaatcagaccattgaaagagaaagaagaaaatttggttaactccttggtcacagccggacaagggcaggttgacaatttttcactaggagtcttgggaatggcattgttcctggaggaaatgcttaggacccgagtaggaacgaaacatgcaatactactagttgcagtttcttttgtgacattgatcacagggaacatgtcctttaaagacctaggaagagtggtggttatggtaggggccaccatgacggatgacataggtatgggcgtaacttatcttgccctactagcagcctttaaagtcagaccaacttttgcagctggactactcttgagaaagctgacctccaaggaattgatgatgaccaccataggaattgtactcctctcccaaagcactataccagaaaccatccttgaattgactgatgcgttagccttaggcatgatggtcctcaaaatagtaagagacatggaaaagtatcaattggcagtgactatcatggctatcttgtgcgtcccaaacgcagtgatattacaaaatgcatggaaagtgagttgcacaatactagcagtggtgtccgtttccccactgcttttgacatcctcacagcaaaaaacggattggataccattagcattgacaatcaagggtctcaatccaacagccatctttctaacaactctctcaagaaccaacaagaaaaggagctggccactaaatgaggccatcatggcagtcggaatggtgagcattttagccagttctctcctaaaaaatgatatccccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctacagaatcaagcaaaaagggattcttggatattcccagatcggagctggagtttataaagaaggaacattccatacgatgtggcatgtcacacgtggcgctgtcctaatgcataaaggaaagaggattgaaccatcatgggcggacgtcaaaaaagatctaatatcatatggaggaggctggaagctagaaggagaatggaaggaaggagaagaagtccaggtgctggcattggagcctgggaaaaatccaagagccgtccaaacaaaacctggtcttttcaaaaccaacaccggaacaataggtgccgtatctctggacttttcccctggaacgtcaggatctccaatcattgacaaaaaaggaaaagttgtgggtctttatggcaatggtgttgttacaaggagtggagcatatgtgagtgctatagcccaaactgaaaaaagcattgaagacaacccagacatcgaagatgacattttccgaaagagaagactgaccatcatggacctccacccaggagcgggaaagacgaaaagataccttccggccatagtcagagaagccataaaacggggtttgagaacattaatcttggcccccaccagagttgtggcagctgaaatggaggaagctctcagaggacttccaataagataccaaaccccagccatcagagctgagcacacagggcgggaaattgtggatctaatgtgtcatgccacatttaccatgaggctgctatcaccagtcagagtgccaaactacaacctgattatcatggatgaagcccatttcacagacccagcaagtatagcagctagaggatacatctcaactcgagtggagatgggtgaagcagctgggattttcatgacagccactcccccgggaagcagagatccatttcctcagagcaatgcaccgatcatagatgaagaaagagaaatccctgaacgttcatggaattctggacacgagtgggttacggattttaaagggaaaactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaggctgagagggttatagaccccagacgctgcatgaagccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacattaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggctggcctacaaagtggcagctgaaggcatcaactatgcagacagaaggtggtgttttgatggaatcaagaacaaccaaatcctggaagagaatgtggaagttgaaatctggacaaaagaaggggaaaggaagaaattgaaacccagatggctggatgctaggatctactctgacccactggcgctaaaagaattcaaagaatttgcagccggaagaaagtctctgaccctgaacctaattacagaaatgggtaggcttccaacattcatgactcagaagacaagagacgcactggacaacttagcagtgctgcacacggccgaagcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgcatagtcacggctagcatccttttatggtacgcacaaatacagccacactggatagcagcttcaataatactggagttttttctcatagttttgcttattccagaaccagaaaaacagagaacaccccaagacaaccaattaacctatgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgccccgcatcagcatggacgctgtatgccgtggctacaacatttgttacaccaatgctgagacatagtattgagaattcctcagtgaatgtatccctaacagctatagctaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccattatagggccaggacttcaagcaaaagcaaccagagaagctcagaaaagagcagcggcgggcatcatgaaaaacccaaccgtagatggaataacagtgattgatctagatccaataccttatgatccaaagttcgaaaagcagttgggacaagtaatgctcctagtcctctgcgtgactcaagtattgatgatgaggactacatgggctctgtgtgaggccttaaccttagctaccgggcccatctccacactgtgggaaggaaatccaggaaggttttggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactgaaaaacgtaagagaagtgaaaggcctaacaaaaggaggaccaggacacgaagaacccatccccatgtcaacatatgggtggaatctagtgcgtcttcaaagtggagttgacgttttcttcatcccgccagaaaagtgtgacacattgttgtgtgacataggggagtcatcaccaaatcctacagtggaagcaggacgaacactcagagtccttaatttagtagaaaattggttgaacaacaacactcaattttgcataaaagttctcaacccatatatgccctcagttatagaaaaaatggaaacactgcaaaggaaatatggaggagccttagtgagaaatccactctcacggaactccacacatgagatgtactgggtatccaatgcttccgggaacatagtgtcatcagtgaacatgatttcaaggatgttgatcaacagattcacaatgagacacaagaaagccacttacgagccggatgttgacctcggaagcggaactcgtaacattggaattgaaagtgagataccaaatctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagcaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccttgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtaccaaaacaaggtggtgcgtgtgcaaagaccaacaccaagaggcacagtaatggacatcatatcaagaagagaccaaagaggtagtgggcaagttggtacctatggactcaatactttcaccaatatggaagcccaattaatcagacagatggagggagaaggagtttttaaaaacattcagcacctgacagtcacagaagaaatcgccgtgcagaactggttagcgagagtagggcgcgaaaggttatcaagaatggccatcagtggagatgattgtgttgtgaaacctttagatgacaggttcgcgagcgctttgacagctctaaatgacatgggaaagattagaaaagacatacaacaatgggaaccttcaagaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggttggcggcaaatgccatttgctcggcagtgccatcacattgggttccaacaagtcgaacaacctggtccatacacgccaaacatgaatggatgacaacggaagacatgctgacagtctggaatagggtgtggattcaagaaaacccatggatggaagacaaaaccccagtggaatcatgggaggaaatcccgtacttggggaaaagagaagaccaatggtgcggctcactgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 721 - DNA, 10176 bp, Dengue virus
atgaataaccaacggaaaaaggcgaaaaacacgcctttcaatatgctgaaacgcgagagaaaccgcgtgtcgactgtgcaacagctgacgaagagattctcacttggaatgctgcagggacgaggaccattaaaactgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgtaggcatgatcattatgctgattccaacagtaatggcgttccatctgaccacacgcaacggagaaccacatatgatcgtcagtatacaagagaaagggaaaagtctcctgtttaaaacagaggatggcgtgaacatgtgcaccctcatggccatggaccttggtgaattgtgtgaagacacaatcacgtacaagtgtccccttctcagacagaatgagccagaagacatagattgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcttgctgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcccgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtagtaacacctcactcaggggaagagcatgctgtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttactcttcactggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgtaaagtcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagttctatcggccagatgtttgagacaacaatgaggggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagttattatcacatggataggaatgaactcacgcagcacctcactgtctgtgtcactagtgttggtgggaattgtgacactgtatttgggagtcatggtgcaggccgatagtggttgcgtcgtgagctggaaaaacaaagaactgaaatgtggcagtggaattttcatcacagacaacgtgcacacatggacagaacaatacaagttccaaccagaatccccttcaaaactagcttcagctatccaaaaagctcaagaagagggaatttgtgggatccgctcagtaacaagattggagaacctaatgtggaaacaaataacaccagaattgaatcacattctagcagaaaatgaggtgaagttaactattatgacaggagacatcaaaggaatcatgcaggcgggaaaacgaactctgcggcctcagcccactgagctaaaatattcatggaaaacatggggcaaagcaaaaatgctctccacagagtctcataaccaaaccttcctcattgatggccccgaaacagcagaatgccccaacacaaatagagcttggaactcgttggaggttgaagactacggctttggagtgttcaccaccaatatatggctaaaattgaaagaaaaacaggatgcattctgcgactcaaaactcatgtcagcggccgtaaaagacaacagagccgtccatgccgacatgggttattggatagagagcgcactcaatgatacatggaagatagagaaagcctctttcattgaagtaaaaaactgccactggccaaaatcacacaccctctggagcaatggagtgctagaaagtgagatgataattccaaagaatctcgctggaccagtgtctcagcacaactatagaccaggctaccatacacaaatagcaggaccatggcatctaggtaagcttgagatggactttgatttctgcgatggaaccacagtggcagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggtcaactccttggtcacagccggacatgggcaggttgacaatttttcactaggagtcttaggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtaacttatcttgccctactagcagctttcaaagtcagaccaacttttgcagctggactactcttgagaaaactgacctccaaggaactgatgatgactaccataggaattgtactcctctcccaaagcactataccagagaccattcttgaattgactgatgcgttagccttaggtatgatggtcctcaaaatagtaagagacatggaaaagtatcaattagcagtgactatcatggctatcttgtgcgtcccaaacgcagtgatattacaaaatgcatggaaagtgagttgcacaatactagcagtggtgtccgtttccccactgcttatgacatcctcacagcaaaaaacggattggataccattggcattgacaatcaaaggtctcaatccaacagccatttttctaacaaccctctcaagaaccaacaagaaaaggagctggccactaaatgaggctatcatggcagtcggaatggtgagcattttagccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggactgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctacagaatcaagcaaaaagggattcttggatattcccagattggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagctagaaggagaatggaaggaaggagaagaagtccaggtgctggcattggagcctggaaaaaatccaagagccgtccaaacaaaacctggtcttttcaaaaccaacactggaacaataggtgccgtatctctggacttttcccctggaacgtcaggatctccaatcattgacaaaaaaggaaaagttgtgggtctttatggtaatggtgttgttacaaggagtggagcatatgtgagtgctatagcccaaactgaaaaaagcattggagacaacccagacatcgaagatgacatttttcgaaagagaagactgaccatcatggacctccacccaggagcgggaaagacgaaaagataccttccggccatagtcagagaagctataaaacggggtttgagaacattaatcttggcccccaccagagttgtggcagctgaaatggaggaagctctcagaggacttccaataagataccaaaccccagccatcagagctgagcacacagggcgggaaattgtggatctaatgtgtcatgccacatttaccatgaggctgctatcaccagttagagtgccaaactacaacctgattatcatggatgaagcccattttacagacccagcaagtatagcagctagaggatacatctcaactcgagtggagatgggtgaagcagctgggattttcatgacagccactcccccgggaagcagagatccatttcctcagagcaatgcaccaatcatagatgaagaaagagaaatccctgagcgttcatggaattctggacatgagtgggtcacggattttaaagggaagactgtttggttcgttccaagcataaaagcaggaaatgatatagcagcttgcctgagaaaaaatggaaagaaagtgatacaacttagtaggaagacttttgattctgagtatgtcaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacattaacacaccagaaggaatcattcccagtatgtttgaaccagagcgtgaaaaagtggatgccattgatggcgaataccgcttgagaggagaagcaaggaaaacctttgtggacttaatgagaagaggagacttaccagtctggttggcctacaaagtggcggctgaaggcatcaactatgcagacagaaggtggtgttttgatggaatcaagaacaaccaaatcctggaagagaatgtggaagttgaaatctggacaaaagaaggggaaaggaagaaattgaaacccagatggctggatgctaggatctactctgacccactggcgctaaaagaattcaaagaatttgcagccggaagaaagtctctgaccctgaacctaattacagaaatgggtaggcttccaacattcatgactcagaagacaagagacgcactggacaacttagcagtgctgcacacggctgaagcaggcggaagggcgtacaatcatgctctcagtgaactgccggagaccctggagacactgcttttactgacacttctggctacagtcacaggagggatctttttattcttgatgagcgggaggggtatagggaagatgaccctaggaatgtgctgcataatcacggctagcatcctcctatggtacgcacaaatacagccacactggatagcagcttcaataatactggagttcttcctcatagttttgcttattccagaaccagaaaaacagagaacaccccaagacaaccaattgacctatgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgccccgcatcagcatggacgctgtacgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccattatagggccaggactccaagcaaaagcaaccagagaagctcagaaaagagcagcggcgggcatcatgaaaaacccaaccgtcgatggaataacagtgattgatctagatccaataccttatgatccaaagtttgaaaagcagttgggacaagtaatgctcctagtcctctgcgtaactcaagtactgatgatgaggactacatgggctctgtgtgaggccttaaccttagctaccgggcccatctccacactgtgggaaggaaatccaggaaggttctggaacactaccatcgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaatatggtcacaccagaagggaaagtagtggacctcggttgtggcagaggaggctggtcatactattgtggaggactgaaaaacgtaagagaagtgaaaggcctaacaaaaggaggaccaggacacgaagaacccatccccatgtcaacatatgggtggaatctagtgcgtcttcaaagtggagttgacgttttcttcatcccgccagaaaagtgtgacacattgttgtgtgacataggggagtcatcaccaaatcctacagtggaagcaggacgaacactcagagtccttaatttagtagaaaattggttgaacaacaacactcaattttgcataaaagttctcaacccatatatgccctcagttatagaaaaaatggaaacactgcaaaggaaatatggaggagccttagtgagaaatccactctcacggaactccacacatgagatgtactgggtatccaatgcttccgggaacatagtgtcatcagtgaacatgatttcaaggatgttgatcaacagattcacaatgagacacaagaaagccacttacgagccggatgttgacctcggaagcggaactcgtaacattggaattgaaagtgagataccaaatctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagcaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctccagagagaactccttgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtaccaaaacaaggtggtgcgtgtgcaaagaccaacaccaagaggcacagtaatggacatcatatcaagaagagaccaaagaggtagtgggcaagttggtacctatggactcaatactttcaccaatatggaagcccaattaatcagacagatggagggagaaggagtttttaaaaacattcagcacctgacagtcacagaagaaatcgccgtgcagaactggttagcgagagtagggcgcgaaaggttatcaagaatggccatcagtggagatgattgtgttgtgaaacctttagatgacaggttcgcgagcgctttgacagctctaaatgacatgggaaagattagaaaagacatacaacaatgggaaccttcaagaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggttggcggcaaatgccatttgctcggcagtgccatcacattgggttccaacaagtcgaacaacctggtccatacacgccaaacatgaatggatgacaacggaagacatgctgacagtctggaatagggtgtggattcaagaaaacccatggatggaagacaaaaccccagtggaatcatgggaggaaatcccgtacttggggaaaagagaagaccaatggtgcggctcactgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 722 - DNA, 10176 bp, Dengue virus
atgaataaccaacggaaaaaggcgaaaagcacgcctttcaatatgctgaaacgcgagagaaaccgcgtgtcgactgtgcaacagctgacgaagagattctcacttggaatgctgcagggacgaggaccattaaaactgttcatggccctggtggcgttccttcgtttcctaacaatcccaccaacagcagggatattgaagagatggggaacaattaaaaaatcaaaagccattaatgttttgagagggttcaggaaagagattggaaggatgctgaacatcttgaataggagacgcagatctgtaggcatgatcattatgctgattccaacagtaatggcgttccatctgaccacacgcaacggagaaccacatatgatcgtcagtatacaagagaaagggaaaagtctcctgtttaaaacagaggatggcgtgaacatgtgcaccctcatggccatggaccttggtgaattgtgtgaagacacaatcacgtacaagtgtccccttctcaggcagaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggtcgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgtttacatgcaagaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagagaaagcctggctggtgcacaggcaatggttcctagatctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagacagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaccaaagaactgaaatgtggcagcgggatcttcattacagataacgtgcacacatggacagaacaatataagttccaaccagaatccccttcaaaactagcttcagctatccaaaaagctcatgaaaagggcatttgtggaatccgctcagtaacaagattggagaatctgatgtggaaacaaataacaccagaattgaatcacatcctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttgttgatggccctgaaacagcagaatgtcccaacacaaacagagcttggaactcgctggaagttgaagactatggttttggagtttttaccaccaatatatggctaaaactgagagaaaaacaagatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccacttcctctggaaaacttataacagaatggtgctgccgatcttgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactggaaacatgtcctttagagacctgggaagagtgatggttatggtgggcgctaccatgacggatgacataggtatgggagtgacttaccttgccctactagcagctttcaaagttagaccaactttcgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatactgctaaacgcatggaaggtgagttgcacaatattggcagcggtgtccgtttctccattgctcttaacatcttcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcactggacgatcggctgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgctggtgatctcaggagtctttccagtatcgataccaatcacggcagcagcatggtacctgtgggaagtgaagaaacaacgggctggagtattgtgggacgttccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcctactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagatccagcaagtatagcagctagaggatatatttcaactcgagtagaaatgggtgaagcagctgggattttcatgacagccactcctccgggaagtagagacccatttcctcagagcaatgcaccaatcatggatgaggaaagagaaatccctgagcgctcgtggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcagagctgagagggttatagaccccagacgttgcatgaaaccagtcatactaacagatggcgaagagcgggtgatcttggcaggacctatgccagtgacccactctagtgcagcacaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgcttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacatggaagtggaaatctggacaaaagaaggggaaaggaagaaattaaaacccagatggttggatgctaggatctattctgacccactggcactaaaagaatttaaggaatttgcagctggaagaaaatctctgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctatgtagtcatagctatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgctgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctattcacaagtcaaccctataactctcacagcagctcttcttttattggtagcacattatgccattatagggccaggacttcaagcaaaagcaactagagaagctcagaaaagagcagcagcaggcatcatgaaaaacccaacagttgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaatacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggttctcaacccatatatgccctcagtcatagaaaaaatggaaacgctacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggatacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagcgggcaagtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgactggacacaagtgcctttctgttcacaccattttcatgagttagtcatgaaagatggtcgcgtgcttgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacatgctaagcatgaatggatgacgacggaagacatgctggcagtctggaatagggtgtggatccaagaaaacccgtggatggaagacaaaactccagtggaatcatgggaagaaatcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 723 - DNA, 10176 bp, Dengue virus
atgaataaccaacgaaaaaaggcgagaaatacccctttcaatatgctgaaacgcgagagaaaccgcgtgtcgactgtacaacagctgacaaagagattctcacttggaatgctgcagggacgaggaccattaaaactgttcatggccctggtggcgttccttcgtttcctaacaatcccaccaacagcagggatactgaagagatggggaacaattaaaaaatcaaaagccattaatgttttgagagggttcaggaaagagattggaaggatgctgaacatcttgaacaggagacgcagaactgcaggcatgatcattatgctgattccaacagtgatggcgttccatttaaccacacgtaacggagaaccacacatgatcgtcagtagacaagagaaagggaaaagtcttctgtttaaaacagaggatggtgtgaacatgtgtaccctcatggccatggaccttggtgaattgtgtgaagatacaatcacgtacaagtgtccttttctcaggcagaatgaaccagaagacatagattgttggtgcaactctacgtccacatgggtaacttatgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacagaagccaaacaacctgccactctaaggaagtactgtatagaggcaaagctgaccaacacaacaacagattctcgctgcccaacacaaggagaacccagcctaaatgaagagcaggacaaaaggttcgtctgcaaacactccatggtggacagaggatggggaaatggatgtggattatttggaaaaggaggcattgtgacctgtgctatgttcacatgcaaaaagaacatgaaaggaaaagtcgtgcaaccagaaaacttggaatacaccattgtgataacacctcactcaggggaagagcatgcagtcggaaatgacacaggaaaacatggcaaggaaatcaaaataacaccacagagttccatcacagaagcagagttgacaggctatggcactgtcacgatggagtgctctccgagaacgggcctcgacttcaatgagatggtgttgctgcaaatggaaaataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacttactgttcacaggacatctcaagtgcaggctgaggatggacaaactacagctcaaaggaatgtcatactctatgtgcacaggaaagtttaaagttgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacagaaaaagatagcccagtcaacatagaagcagaacctccattcggagacagctacatcatcataggagtagagccgggacaattgaagctcaactggtttaagaaaggaagttctatcggccaaatgattgagacaacaatgaggggagcgaagagaatggccattttaggtgacacagcttgggattttggatccctgggaggagtgtttacatctataggaaaggctctccaccaagttttcggagcaatctatggggctgccttcagtggggtctcatggactatgaaaatactcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaagtgtggcagtgggattttcatcacagacaacgtgcacacatggacagaacaatacaagttccaaccagaatccccttcaaagctagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcagccccagcccactgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagtcacacaccctctggagtaatggagtgttagaaagtgagatgataattccaaagaatttcgctggaccagtgtcacaacacaactacagaccaggctaccatacacaaacagcaggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgatgcgttagccttgggcatgatggtccttaaaatggtgagaaaaatggaaaagtatcaattggcagtgactatcatggctatcttgtgcgtcccaaatgcagtgatattacaaaacgcatggaaagtgagttgcacaatattggcagtggtgtccgtttccccactgttcttaacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctgtatcaataccaatcacggcagcagcatggtacctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgcggcgctgttctaatgcataaaggaaagaggattgaaccatcatgggcggacgttaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagtattgaagacaatccagagatcgaagatgatatttttcgaaagagaaaattgaccatcatggacctccacccaggagcgggaaagacgaagagataccttccggccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggtcacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactgacgctaaaggaattcaaggagtttgcagctggaagaaagtccctgaccctgaacctaatcacagaaatgggtaggcttccaactttcatgactcagaaggcaagagacgcactggacaacttagcagtgctgcacacggctgaagcaggtggaagggcgtacaatcatgctctcagtgaactgccggagaccctggagacattgcttttactgacacttctggctacagtcacaggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagggaagctcagaaaagagcagcagcgggcatcatgaaaaacccaactgtcgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacatttttagagggagttacttggccggagctggacttctcttttccatcatgaagaacacaaccaacacgagaaggggaactggcaacataggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctgacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccacttacgagccagatgtagacctcggaagcggaacccgcaacatcggaattgaaagtgagataccaaacctagacataatcgggaaaagaatagaaaaaataaaacaagagcatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtataacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccttgagtggagtggaaggagaagggctgcacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaagcattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccaaggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 724 - DNA, 10176 bp, Dengue virus
atgaataaccaacgaaaaaaggcgagaaatacccctttcaatatgctgaaacgcgagagaaaccgcgtgtcgactgtacaacagctgacaaagagattctcacttggaatgctgcagggacgaggaccattaaaactgttcatggccctggtggcgttccttcgtttcctaacaatcccaccaacagcagggatactgaagagatggggaacaattaaaaaatcaaaagccattaatgttttgagagggttcaggaaagagattggaaggatgctgaacatcttgaacaggagacgcagaactgcaggcatgatcattatgctgattccaacagtaatggcgttccatctaaccacacgtaacggagaaccacacatgatcgtcagtagacaagagaaagggaaaagtcttttgtttaaaacagaggatggcgtgaacatgtgcaccctcatggccatggaccttggtgaattgtgtgaagacacaatcacgtacaagtgtccccttctcaggcagaatgagccagaagacatagactgctggtgcaactccacgtccacgtgggtaacctatgggacttgtaccaccacgggagaacatagaagagaaaaaagatcagtggcactcgttccacatgtgggaatgggactggagacgcgaactgaaacatggatgtcatcagaaggggcttggaaacatgcccagagaattgaaatttggatcctgagacatccaggcttcaccataatggcagcaatcctggcatacaccatagggacgacacatttccagagagcactgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgttgcccaacacaaggggaacccagcctaaatgaagagcaggataaaaggttcgtctgcaaacactccatggtagacagaggatggggaaatggatgtggattatttggaaagggaggcattgtgacctgtgctatgttcacatgcaaaaagaacatggagggaaaagttgtgcagccagaaaacttggaatacaccattgtggtaacaccccactcaggggaagagcatgcggtcggaaatgacacaggaaaacatggcaaggaaatcaaagtaacaccacagagttccatcacagaagcagaattgacaggttatggcactgtcacgatggagtgctctccgagaacaggcctcgacttcaatgagatggtgttgctgcagatggaaaataaagcttggctggtgcataggcaatggttcctagacctgccgttaccatggctgcccggagcggacacacaagggtcaaattggatacaaaaagaaacattggtcactttcaaaaatcctcatgcgaagaaacaggatgttgttgttttaggatcccaagaaggggccatgcacacagcactcacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagggtgcagtatgaaggggacggctctccatgtaaaatcccttttgagataatggatttggaaaaaagacatgtcttaggtcgcctgatcacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttgggtgacacagcctgggattttggatccctgggaggagtgtttacatctataggaaaagccctccaccaagtctttggagcaatctatggagctgccttcagtggggtctcatggactatgaaaatcctcataggagtcattatcacatggataggaatgaattcacgcagcacctcactgtctgtgtcactagtattggtgggagtcgtgacgctgtatttgggagttatggtgcaggccgatagtggttgcgttgttagctggaaaaacaaagaactgaagtgtggcagtgggattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcagccccagcccactgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagtcacacaccctctggagtaatggagtgttagaaagtgagatgataattccaaagaatttcgctggaccagtgtcacaacacaactacagaccaggctaccatacacaaacagcaggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgatgcgttagccttgggcatgatggtccttaaaatggtgagaaaaatggaaaagtatcaattggcagtgactatcatggctatcttgtgcgtcccaaatgcagtgatattacaaaacgcatggaaagtgagttgcacaatattggcagtggtgtccgtttccccactgttcttaacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctgtatcaataccaatcacggcagcagcatggtacctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgcggcgctgttctaatgcataaaggaaagaggattgaaccatcatgggcggacgttaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagtattgaagacaatccagagatcgaagatgatatttttcgaaagagaaaattgaccatcatggacctccacccaggagcgggaaagacgaagagataccttccggccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggtcacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactgacgctaaaggaattcaaggagtttgcagctggaagaaagtccctgaccctgaacctaatcacagaaatgggtaggcttccaactttcatgactcagaaggcaagagacgcactggacaacttagcagtgctgcacacggctgaagcaggtggaagggcgtacaatcatgctctcagtgaactgccggagaccctggagacattgcttttactgacacttctggctacagtcacaggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagggaagctcagaaaagagcagcagcgggcatcatgaaaaacccaactgtcgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacatttttagagggagttacttggccggagctggacttctcttttccatcatgaagaacacaaccaacacgagaaggggaactggcaacataggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctgacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccacttacgagccagatgtagacctcggaagcggaacccgcaacatcggaattgaaagtgagataccaaacctagacataatcgggaaaagaatagaaaaaataaaacaagagcatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtataacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccttgagtggagtggaaggagaagggctgcacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaagcattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccaaggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 725 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggttggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccatttggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgttgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtag

SEQ ID NO: 726 - DNA, 10176 bp, Dengue virus
atgaataaccaacggaaaaaggcgagaaacacgcctttcaatatgctgaaacgcgagagaaaccgcgtgtcaactgtacaacagttgacaaagagattctcacttggaatgctgcagggacgaggaccactaaaattgttcatggccctggtggcattccttcgtttcctaacaatcccaccaacagcagggatattaaaaagatggggaacaattaaaaaatcaaaggctattaatgttctgagaggcttcaggaaagagattggaaggatgctgaatatcttaaacaggagacgtagaactgtaggcatgatcatcatgctgactccaacagtgatggcgtttcatctgaccacacgcaacggagaaccacacatgattgtcagtagacaagaaaaagggaaaagccttctgttcaagacaaaggatggcacgaacatgtgtaccctcatggccatggaccttggtgagttgtgtgaagacacaatcacgtataaatgtccttttctcaagcagaacgaaccagaagacatagattgttggtgcaactccacgtccacatgggtaacttatgggacatgtaccaccacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggctttaccataatggccgcaatcctggcatacaccatagggacgacgcatttccaaagagtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaacaaaccaacactggactttgaactgataaaaacagaagccaaacaacctgccaccttaaggaagtactgtatagaggccaaactgaccaacacgacaacagactcgcgctgcccaacacaaggggaacccaccctgaatgaagagcaggacaaaaggtttgtctgcaaacattccatggtagacagaggatggggaaatggatgtggattgtttggaaaaggaggcatcgtgacctgtgctatgttcacatgcaaaaagaacatggaaggaaaaattgtgcagccagaaaacctggaatacactgtcgtgataacacctcattcaggggaagaacatgcagtgggaaatgacacaggaaaacatggtaaagaagtcaagataacaccacagagctccatcacagaggcggaactgacaggctatggcactgttacgatggagtgctctccaagaacgggcctcgacttcaatgagatggtgttgctgcaaatggaagacaaagcctggctggtgcacagacaatggttcctagacctaccgttgccatggctgcccggagcagacacacaaggatcaaattggatacagaaagaaacactggtcaccttcaaaaatccccatgcgaaaaaacaggatgttgttgtcttaggatcccaagagggggccatgcatacagcactcacaggggctacggaaatccagatgtcatcaggaaacctgctgttcacaggacatctcaagtgcaggctgagaatggacaaattacaacttaaagggatgtcatactccatgtgcacaggaaagtttaaaattgtgaaggaaatagcagaaacacaacatggaacaatagtcattagagtacaatatgaaggagacggctctccatgcaagatcccctttgagataatggatctggaaaaaagacatgttttgggccgcctgatcacagtcaacccaattgtaacagaaaaggacagtccagtcaacatagaagcagaacctccattcggagacagctacatcatcataggagtggaaccaggacaattgaagctggactggttcaagaaaggaagttccatcggccaaatgtttgagacaacaatgaggggagcgaaaagaatggccattttgggtgacacagcctgggattttggatctctgggaggagtgttcacatcaataggaaaggctctccaccaggtttttggagcaatctacggggctgctttcagtggggtctcatggactatgaagatcctcataggagttatcatcacatggataggaatgaactcacgtagcactagtctgagcgtgtcactggtgttagtgggaatcgtgacactttacttgggagttatggtgcaggccgatagtggttgcgttgtgagctggaagaacaaagaactaaaatgtggcagtggaatattcgtcacagataacgtgcatacatggacagaacaatacaagttccaaccagaatccccttcaaaactggcctcagccatccagaaagcgcatgaagagggcatctgtggaatccgctcagtaacaagactggaaaatcttatgtggaaacagataacatcagaattgaatcatattctatcagaaaatgaagtgaaactgaccatcatgacaggagacatcaaaggaatcatgcaggtaggaaaacgatctttgcggcctcaacccactgagttgaggtattcatggaaaacatggggtaaagcgaaaatgctctccacagaactccacaatcagaccttcctcattgatggtcccgaaacagcagaatgccccaacacaaacagagcttggaattcactggaagttgaggactacggctttggagtattcactaccaatatatggctaagattgagagaaaagcaggatgtattttgtgactcaaaactcatgtcagcggccataaaggacaacagagccgtccatgctgatatgggttattggatagaaagcgcactcaatgatacatggaagatagagaaagcttctttcattgaagtcaaaagttgccactggccaaagtcacacaccctatggagtaatggagtgctagaaagcgagatggtcattccaaagaatttcgctggaccagtgtcacaacataataacagaccaggctattacacacaaacagcaggaccttggcatctaggcaagcttgagatggactttgatttctgcgaagggactacagtggtggtaaccgagaactgtggaaacagagggccctctttaagaacaaccactgcctcaggaaaactcataacggaatggtgttgtcgatcttgcacactaccaccactaagatacagaggtgaggatggatgttggtacgggatggaaatcagaccattgaaagagaaagaagaaaatctggtcagttctctggttacagccggacatgggcagattgacaatttctcattaggaatcttgggaatggcactgttccttgaagaaatgctcaggactcgagtaggaacaaaacatgcaatattactcgtcgcagtttctttcgtgacgctaatcacagggaacatgtcttttagagacctgggaagagtgatggttatggtgggtgccaccatgacagatgacataggcatgggtgtgacttatctcgctctactagcagcttttagagtcagaccaacctttgcagctggactgctcttgagaaaactgacctccaaggaattaatgatgactaccataggaatcgttcttctctcccagagtagcataccagagaccattcttgaactgaccgacgcgttagctctaggcatgatggtcctcaagatggtgagaaacatggaaaaatatcagctggcagtgaccatcatggctattttgtgcgtcccaaatgctgtgatattacagaacgcatggaaagtgagttgcacaatattggcagtggtgtctgtttcccccctgctcttaacatcctcacaacagaaagcggactggataccattagcgttgacgatcaaaggtcttaatccaacagccatttttctaacaaccctctcaagaaccaacaagaaaaggagctggcctttaaatgaggccatcatggcggttgggatggtgagtatcttggccagctctctcttaaagaatgacatccccatgacaggaccattagtggctggagggctccttactgtgtgctacgtgctaactgggcggtcagccgatctggaattagagagagctaccgatgtcaaatgggatgaccaggcagagatatcaggtagcagtccaatcctgtcaataacaatatcagaagatggcagcatgtcaataaagaatgaagaggaagagcaaacactgactatactcattagaacaggattgcttgtgatctcaggactctttccggtatcaataccaattacagcagcagcatggtatctgtgggaagtaaagaaacaacgggctggagtgctgtgggatgtcccctcaccaccacccgtgggaaaagctgaattggaagatggagcctacagaatcaagcaaaaaggaatccttggatattcccagatcggagctggagtttacaaagaaggaacatttcacacaatgtggcacgtcacacgtggcgctgtcctaatgcataaggggaagaggattgaaccatcatgggcggacgtcaagaaagacttaatatcatatggaggaggttggaagctagaaggagaatggaaagaaggagaagaagtccaggtcttggcattggagccagggaaaaatccaagagccgtccaaacaaagcctggcctttttagaaccaacactggaaccataggtgccgtatctctggacttttcccctgggacgtcaggatctccaatcgtcgacaaaaaaggaaaagttgtaggtctctatggcaatggtgtcgttacacgcctaggagcatatgtgagtgccatagctcagactgaaaaaagcattgaagacaatccagagattgaagatgacatctttcgaaagagaagattgactatcatggatctccacccaggagcaggaaagacaaagagatacctcccggccatagtcagagaggccataaaaagaggcttgagaacactaatcctagcccccactagagtcgtggcagctgaaatggaggaagcccttagaggacttccaataagataccaaactccagctatcagggctgagcacaccgggcgggagattgtagacttaatgtgtcatgccacatttaccatgaggctgctatcaccaatcagggtgccaaattacaacctgatcatcatggacgaagcccattttacagatccagcaagcatagcagctaggggatacatctcaactcgagtggagatgggggaggcagctggaatttttatgacagccactcctccgggtagtagagatccatttcctcagagcaatgcaccaattatggacgaagaaagagaaattccggaacgttcatggaactctgggcacgagtgggtcacggattttaaaggaaagactgtctggtttgttccaagcataaaaaccggaaatgacatagcagcctgcctgagaaagaatggaaagagggtgatacaactcagtaggaagacctttgattctgaatatgtcaagactagaaccaatgactgggatttcgtggttacaactgacatctcggaaatgggcgccaactttaaagctgagagggtcatagaccccagacgctgcatgaaaccagttatattgacagacggcgaagagcgggtgattctggcaggacccatgccagtgacccactctagtgcagcacaaagaagagggagaataggaaggaatccaaggaatgaaaatgatcaatatatatatatgggggaaccactggaaaatgatgaagactgtgcgcactggaaggaagctaagatgctcctagataatatcaacacacctgaaggaatcattcccagcttgttcgagccagagcgtgaaaaggtggatgccattgacggtgaatatcgcttgagaggagaagcacggaaaacttttgtggacctaatgagaagaggagacctaccagtctggttggcttataaagtggcagctgaaggtatcaactacgcagacagaagatggtgttttgacggaaccagaaacaatcaaatcttggaagaaaatgtggaagtggaaatctggacaaaggaaggggaaaggaaaaaattgaaacctagatggttagatgctaggatctactccgacccactggcgctaaaagagttcaaggaatttgcagccggaagaaagtccctaaccctgaacctaattacagagatgggcagactcccaacttttatgactcagaaggccagagatgcactagacaacttggcggtgctgcacacggctgaagcgggtggaaaggcatacaatcatgctctcagtgaattaccggagaccctggagacattgcttttgctgacactgttggccacagtcacgggaggaatcttcctattcctgatgagcggaaggggtatggggaagatgaccctgggaatgtgctgcataatcacggccagcatcctcttatggtatgcacaaatacagccacattggatagcagcctcaataatattggagttctttctcatagtcttgctcattccagaaccagaaaagcagaggacacctcaggataatcaattgacttatgtcatcatagccatcctcacagtggtggccgcaaccatggcaaacgaaatgggttttctggaaaaaacaaagaaagacctcggactgggaaacattgcaactcagcaacctgagagcaacattctggacatagatctacgtcctgcatcagcatggacgttgtatgccgtggctacaacatttatcacaccaatgttgagacatagcattgaaaattcctcagtaaatgtgtccctaacagccatagctaaccaagccacagtgctaatgggtctcggaaaaggatggccattgtcaaagatggacattggagttcccctccttgctattgggtgttactcacaagtcaaccctataaccctcacagcggctcttcttttattggtagcacattatgccatcataggaccgggacttcaagccaaagcaactagagaagctcagaaaagagcagcagcgggcatcatgaaaaacccaactgtggatggaataacagtgatagatctagatccaataccctatgatccaaagtttgaaaagcagttgggacaagtaatgctcctagtcctctgcgtgacccaagtgctgatgatgaggactacgtgggctttgtgtgaagccttaactctagcaactggacccgtgtccacattgtgggaaggaaatccagggagattctggaacacaaccattgcagtgtcaatggcaaacatctttagagggagttacctggctggagctggacttctcttttctatcatgaagaacacaaccagcacgagaagaggaactggcaatataggagaaacgttaggagagaaatggaaaagcagactgaacgcattggggaaaagtgaattccagatctacaaaaaaagtggaattcaagaagtggacagaaccttagcaaaagaaggcattaaaagaggagaaacggatcatcacgctgtgtcgcgaggctcagcaaaactgagatggttcgttgaaaggaatttggtcacaccagaagggaaagtagtggaccttggttgtggcagagggggctggtcatactattgtggaggattaaagaatgtaagagaagttaaaggcttaacaaaaggaggaccaggacacgaagaacctatccctatgtcaacatatgggtggaatctagtacgcttacagagcggagttgatgttttttttgttccaccagagaagtgtgacacattgttgtgtgacataggggaatcatcaccaaatcccacggtagaagcgggacgaacactcagagtcctcaacctagtggaaaattggctgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgatcaacagattcactatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgatcaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactccttttggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgtaccagagaagaattcacaaaaaaggtgagaagcaatgcagccttgggggccatattcaccgatgagaacaagtggaaatcggcgcgtgaagccgttgaagatagtaggttttgggagctggttgacaaggaaaggaacctccatcttgaagggaaatgtgaaacatgtgtatacaacatgatggggaaaagagagaaaaaactaggagagtttggtaaagcaaaaggcagcagagccatatggtacatgtggctcggagcacgcttcttagagtttgaagccctaggatttttgaatgaagaccattggttctccagagagaactccctgagtggagtggaaggagaagggctgcataagctaggttacatcttaagagaggtgagcaagaaagaaggaggagcaatgtatgccgatgacaccgcaggctgggacacaagaatcacaatagaggatttgaaaaatgaagaaatgataacgaaccacatggcaggagaacacaagaaacttgccgaggccatttttaaattgacgtaccaaaacaaggtggtgcgtgtgcaaagaccaacaccaagaggcacagtaatggacatcatatcgagaagagaccaaaggggtagtggacaagttggcacctatggcctcaacactttcaccaacatggaagcacaactaattaggcaaatggagggggaaggaatcttcaaaagcatccagcacttgacagcctcagaagaaatcgctgtgcaagattggctagtaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacgcaggtgcccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccatcacactggattccaacaagccggacaacctggtccatacacgccagccatgaatggatgacgacggaagacatgttgacagtttggaacagagtgtggatcctagaaaatccatggatggaagacaaaactccagtggaatcatgggaggaaatcccatacctgggaaaaagagaagaccaatggtgcggctcgctgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtggtag

SEQ ID NO: 727 - DNA, 10176 bp, Dengue virus
atgaataaccaacggaaaaaggcgagaaacacgcctttcaatatgctgaaacgcgagagaaaccgcgtgtcaactgtacaacagttgacaaagagattctcacttggaatgctgcagggacgaggaccactaaaattgttcatggccctggtggcattccttcgtttcctaacaatcccaccaacagcagggatattaaaaagatggggaacaattaaaaaatcaaaggctattaatgttctgagaggcttcaggaaagagattggaaggatgctgaatatcttaaacaggagacgtagaactgtaggcatgatcatcatgctgactccaacagtgatggcgtttcatctgaccacacgcaacggagaaccacacatgattgtcagtagacaagaaaaagggaaaagccttctgttcaagacaaaggatggcacgaacatgtgtaccctcatggccatggaccttggtgagttgtgtgaagacacaatcacgtataaatgtccttttctcaagcagaacgaaccagaagacatagattgttggtgcaactccacgtccacatgggtaacttatgggacatgtaccaccacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggctttaccataatggccgcaatcctggcatacaccatagggacgacgcatttccaaagagtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaacaaaccaacactggactttgaactgataaaaacagaagccaaacaacctgccaccttaaggaagtactgtatagaggccaaactgaccaacacgacaacagactcgcgctgcccaacacaaggggaacccaccctgaatgaagagcaggacaaaaggtttgtctgcaaacattccatggtagacagaggatggggaaatggatgtggattgtttggaaaaggaggcatcgtgacctgtgctatgttcacatgcaaaaagaacatggaaggaaaaattgtgcagccagaaaacctggaatacactgtcgtgataacacctcattcaggggaagaacatgcagtgggaaatgacacaggaaaacatggtaaagaagtcaagataacaccacagagctccatcacagaggcggaactgacaggctatggcactgttacgatggagtgctctccaagaacgggcctcgacttcaatgagatggtgttgctgcaaatggaagacaaagcctggctggtgcacagacaatggttcctagacctaccgttgccatggctgcccggagcagacacacaaggatcaaattggatacagaaagaaacactggtcaccttcaaaaatccccatgcgaaaaaacaggatgttgttgtcttaggatcccaagagggggccatgcatacagcactcacaggggctacggaaatccagatgtcatcaggaaacctgctgttcacaggacatctcaagtgcaggctgagaatggacaaattacaacttaaagggatgtcatactccatgtgcacaggaaagtttaaaattgtgaaggaaatagcagaaacacaacatggaacaatagtcattagagtacaatatgaaggagacggctctccatgcaagatcccctttgagataatggatctggaaaaaagacatgttttgggccgcctgatcacagtcaacccaattgtaacagaaaaggacagtccagtcaacatagaagcagaacctccattcggagacagctacatcatcataggagtggaaccaggacaattgaagctggactggttcaagaaaggaagttccatcggccaaatgtttgagacaacaatgaggggagcgaaaagaatggccattttgggtgacacagcctgggattttggatctctgggaggagtgttcacatcaataggaaaggctctccaccaggtttttggagcaatctacggggctgctttcagtggggtctcatggactatgaagatcctcataggagttatcatcacatggataggaatgaactcacgtagcactagtctgagcgtgtcactggtgttagtgggaatcgtgacactttacttgggagttatggtgcaggccgatagtggttgcgttgtgagctggaagaacaaagaactaaaatgtggcagtggaatattcgtcacagataacgtgcatacatggacagaacaatacaagttccaaccagaatccccttcaaaactggcctcagccatccagaaagcgcatgaagagggcatctgtggaatccgctcagtaacaagactggaaaatcttatgtggaaacagataacatcagaattgaatcatattctatcagaaaatgaagtgaaactgaccatcatgacaggagacatcaaaggaatcatgcaggtaggaaaacgatctttgcggcctcaacccactgagttgaggtattcatggaaaacatggggtaaagcgaaaatgctctccacagaactccacaatcagaccttcctcattgatggtcccgaaacagcagaatgccccaacacaaacagagcttggaattcactggaagttgaggactacggctttggagtattcactaccaatatatggctaagattgagagaaaagcaggatgtattttgtgactcaaaactcatgtcagcggccataaaggacaacagagccgtccatgctgatatgggttattggatagaaagcgcactcaatgatacatggaagatagagaaagcttctttcattgaagtcaaaagttgccactggccaaagtcacacaccctatggagtaatggagtgctagaaagcgagatggtcattccaaagaatttcgctggaccagtgtcacaacataataacagaccaggctattacacacaaacagcaggaccttggcatctaggcaagcttgagatggactttgatttctgcgaagggactacagtggtggtaaccgagaactgtggaaacagagggccctctttaagaacaaccactgcctcaggaaaactcataacggaatggtgttgtcgatcttgcacactaccaccactaagatacagaggtgaggatggatgttggtacgggatggaaatcagaccattgaaagagaaagaagaaaatctggtcagttctctggttacagccggacatgggcagattgacaatttctcattaggaatcttgggaatggcactgttccttgaagaaatgctcaggactcgagtaggaacaaaacatgcaatattactcgtcgcagtttctttcgtgacgctaatcacagggaacatgtcttttagagacctgggaagagtgatggttatggtgggtgccaccatgacagatgacataggcatgggtgtgacttatctcgctctactagcagcttttagagtcagaccaacctttgcagctggactgctcttgagaaaactgacctccaaggaattaatgatgactaccataggaatcgttcttctctcccagagtagcataccagagaccattcttgaactgaccgacgcgttagctctaggcatgatggtcctcaagatggtgagaaacatggaaaaatatcagctggcagtgaccatcatggctattttgtgcgtcccaaatgctgtgatattacagaacgcatggaaagtgagttgcacaatattggcagtggtgtctgtttcccccctgctcttaacatcctcacaacagaaagcggactggataccattagcgttgacgatcaaaggtcttaatccaacagccatttttctaacaaccctctcaagaaccaacaagaaaaggagctggcctttaaatgaggccatcatggcggttgggatggtgagtatcttggccagctctctcttaaagaatgacatccccatgacaggaccattagtggctggagggctccttactgtgtgctacgtgctaactgggcggtcagccgatctggaattagagagagctaccgatgtcaaatgggatgaccaggcagagatatcaggtagcagtccaatcctgtcaataacaatatcagaagatggcagcatgtcaataaagaatgaagaggaagagcaaacactgactatactcattagaacaggattgcttgtgatctcaggactctttccggtatcaataccaattacagcagcagcatggtatctgtgggaagtaaagaaacaacgggctggagtgctgtgggatgtcccctcaccaccacccgtgggaaaagctgaattggaagatggagcctacagaatcaagcaaaaaggaatccttggatattcccagatcggagctggagtttacaaagaaggaacatttcacacaatgtggcacgtcacacgtggcgctgtcctaatgcataaggggaagaggattgaaccatcatgggcggacgtcaagaaagacttaatatcatatggaggaggttggaagctagaaggagaatggaaagaaggagaagaagtccaggtcttggcattggagccagggaaaaatccaagagccgtccaaacaaagcctggcctttttagaaccaacactggaaccataggtgccgtatctctggacttttcccctgggacgtcaggatctccaatcgtcgacaaaaaaggaaaagttgtaggtctctatggcaatggtgtcgttacaaggagtggagcatatgtgagtgccatagctcagactgaaaaaagcattgaagacaatccagagattgaagatgacatctttcgaaagagaagattgactatcatggatctccacccaggagcaggaaagacaaagagatacctcccggccatagtcagagaggccataaaaagaggcttgagaacactaatcctagcccccactagagtcgtggcagctgaaatggaggaagcccttagaggacttccaataagataccaaactccagctatcagggctgagcacaccgggcgggagattgtagacttaatgtgtcatgccacatttaccatgaggctgctatcaccaatcagggtgccaaattacaacctgatcatcatggacgaagcccattttacagatccagcaagcatagcagctaggggatacatctcaactcgagtggagatgggggaggcagctggaatttttatgacagccactcctccgggtagtagagatccatttcctcagagcaatgcaccaattatggacgaagaaagagaaattccggaacgttcatggaactctgggcacgagtgggtcacggattttaaaggaaagactgtctggtttgttccaagcataaaaaccggaaatgacatagcagcctgcctgagaaagaatggaaagagggtgatacaactcagtaggaagacctttgattctgaatatgtcaagactagaaccaatgactgggatttcgtggttacaactgacatctcggaaatgggcgccaactttaaagctgagagggtcatagaccccagacgctgcatgaaaccagttatattgacagacggcgaagagcgggtgattctggcaggacccatgccagtgacccactctagtgcagcacaaagaagagggagaataggaaggaatccaaggaatgaaaatgatcaatatatatatatgggggaaccactggaaaatgatgaagactgtgcgcactggaaggaagctaagatgctcctagataatatcaacacacctgaaggaatcattcccagcttgttcgagccagagcgtgaaaaggtggatgccattgacggtgaatatcgcttgagaggagaagcacggaaaacttttgtggacctaatgagaagaggagacctaccagtctggttggcttataaagtggcagctgaaggtatcaactacgcagacagaagatggtgttttgacggaaccagaaacaatcaaatcttggaagaaaatgtggaagtggaaatctggacaaaggaaggggaaaggaaaaaattgaaacctagatggttagatgctaggatctactccgacccactggcgctaaaagagttcaaggaatttgcagccggaagaaagtccctaaccctgaacctaattacagagatgggcagactcccaacttttatgactcagaaggccagagatgcactagacaacttggcggtgctgcacacggctgaagcgggtggaaaggcatacaatcatgctctcagtgaattaccggagaccctggagacattgcttttgctgacactgttggccacagtcacgggaggaatcttcctattcctgatgagcggaaggggtatggggaagatgaccctgggaatgtgctgcataatcacggccagcatcctcttatggtatgcacaaatacagccacattggatagcagcctcaataatattggagttctttctcatagtcttgctcattccagaaccagaaaagcagaggacacctcaggataatcaattgacttatgtcatcatagccatcctcacagtggtggccgcaaccatggcaaacgaaatgggttttctggaaaaaacaaagaaagacctcggactgggaaacattgcaactcagcaacctgagagcaacattctggacatagatctacgtcctgcatcagcatggacgttgtatgccgtggctacaacatttatcacaccaatgttgagacatagcattgaaaattcctcagtaaatgtgtccctaacagccatagctaaccaagccacagtgctaatgggtctcggaaaaggatggccattgtcaaagatggacattggagttcccctccttgctattgggtgttactcacaagtcaaccctataaccctcacagcggctcttcttttattggtagcacattatgccatcataggaccgggacttcaagccaaagcaactagagaagctcagaaaagagcagcagcgggcatcatgaaaaacccaactgtggatggaataacagtgatagatctagatccaataccctatgatccaaagtttgaaaagcagttgggacaagtaatgctcctagtcctctgcgtgacccaagtgctgatgatgaggactacgtgggctttgtgtgaagccttaactctagcaactggacccgtgtccacattgtgggaaggaaatccagggagattctggaacacaaccattgcagtgtcaatggcaaacatctttagagggagttacctggctggagctggacttctcttttctatcatgaagaacacaaccagcacgagaagaggaactggcaatataggagaaacgttaggagagaaatggaaaagcagactgaacgcattggggaaaagtgaattccagatctacaaaaaaagtggaattcaagaagtggacagaaccttagcaaaagaaggcattaaaagaggagaaacggatcatcacgctgtgtcgcgaggctcagcaaaactgagatggttcgttgaaaggaatttggtcacaccagaagggaaagtagtggaccttggttgtggcagagggggctggtcatactattgtggaggattaaagaatgtaagagaagttaaaggcttaacaaaaggaggaccaggacacgaagaacctatccctatgtcaacatatgggtggaatctagtacgcttacagagcggagttgatgttttttttgttccaccagagaagtgtgacacattgttgtgtgacataggggaatcatcaccaaatcccacggtagaagcgggacgaacactcagagtcctcaacctagtggaaaattggctgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgatcaacagattcactatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgatcaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactccttttggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgtaccagagaagaattcacaaaaaaggtgagaagcaatgcagccttgggggccatattcaccgatgagaacaagtggaaatcggcgcgtgaagccgttgaagatagtaggttttgggagctggttgacaaggaaaggaacctccatcttgaagggaaatgtgaaacatgtgtatacaacatgatggggaaaagagagaaaaaactaggagagtttggtaaagcaaaaggcagcagagccatatggtacatgtggctcggagcacgcttcttagagtttgaagccctaggatttttgaatgaagaccattggttctccagagagaactccctgagtggagtggaaggagaagggctgcataagctaggttacatcttaagagaggtgagcaagaaagaaggaggagcaatgtatgccgatgacaccgcaggctgggacacaagaatcacaatagaggatttgaaaaatgaagaaatgataacgaaccacatggcaggagaacacaagaaacttgccgaggccatttttaaattgacgtaccaaaacaaggtggtgcgtgtgcaaagaccaacaccaagaggcacagtaatggacatcatatcgagaagagaccaaaggggtagtggacaagttggcacctatggcctcaacactttcaccaacatggaagcacaactaattaggcaaatggagggggaaggaatcttcaaaagcatccagcacttgacagcctcagaagaaatcgctgtgcaagattggctagtaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacgcaggtgcccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccatcacactggattccaacaagccggacaacctggtccatacacgccagccatgaatggatgacgacggaagacatgttgacagtttggaacagagtgtggatcctagaaaatccatggatggaagacaaaactccagtggaatcatgggaggaaatcccatacctgggaaaaagagaagaccaatggtgcggctcgctgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtggtag

SEQ ID NO: 728 - DNA, 10176 bp, Dengue virus; identical to SEQ ID NO: 727

SEQ ID NO: 729 - DNA, 10176 bp, Dengue virus
atgaataaccaacgaaaaaaggcgagaaacacgcctttcaatatgctgaaacgcgagagaaaccgcgtgtcaaccgtacaacagttgacaaagagattctcacttggaatgctgcagggacgaggaccattaaaattgttcatggccctggtggcattccttcgtttcctaacaatcccaccaacagcagggatattaaaaagatggggaacaattaaaaaatcaaaggctattaatgttctaagaggcttcaggaaagagattggaaggatgctgaatatcttaaacaggagacgtagaactgcaggcatgatcatcatgctgattccaacagtgatggcatttcatctgaccacacgcaacggagaaccacacatgatcgtcagtagacaagaaaaagggaaaagccttctgtttaagacaaaggatggcacgaatatgtgtactctcatggccttggaccttggtgagttgtgtgaagacacaatcacgtataaatgtccttttctcaagcagaacgaaccagaagacatagattgttggtgcaactccacgtccacatgggtaacttacgggacatgtaccaccacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggctttaccataatggccgcaatcctggcatacaccataggaacgacgcatttccaaagagtcctgatattcatcctactgacagccatcgccccttcaatggcaatgcgctgcataggaatatcaaatagggactttgtggaaggagtgtcaggagggagttgggttgacatagttttagagcatggaagttgtgtgacgacgatggcaaaaaataaaccaacactggactttgaactgataaaaacagaagccaaacaacccgccaccttaaggaagtactgtatagaggctaaactgaccaacacgacaacagactcgcgctgcccaacacaaggggaacccaccctgaatgaagagcaggacaaaaggtttgtctgcaaacattccatggtagacagaggatggggaaatggatgtggattgtttggaaaaggaggcatcgtgacctgtgctatgttcacatgcaaaaagaacatggaaggaaaaattgtgcagccagaaaacctggaatacactgtcgtgataacacctcattcaggggaagaacatgcagtcggaaatgacacaggaaaacatggtaaagaagtcaagataacaccacagagctccatcacagaggcggaactgacaggctatggcactgttacgatggagtgctctccaagaacgggcctcgacttcaatgagatggtgttgctgcaaatggaagacaaagcttggctggtgcacagacaatggttcctagacctaccgttgccatggctgcccggagcagacacacaaggatcaaattggatacagaaagagacattggtcaccttcaagaatccccatgcgaaaaaacaggatgttgttgtcttaggatcccaagaaggggccatgcatacagcactcacaggggctacggaaatccagatgtcatcaggaaacctgctgttcacaggacatcttaaatgcaggctgagaatggacaaattacaacttaaagggatgtcatactccatgtgcacaggaaagtttaaaattgtgaaggaaatagcagaaacacaacatggaacaatagtcattagagtacaatatgaaggagacggctctccatgcaagatcccctttgagataatggatctggaaaaaagacatgttttgggccgcctgatcacagtcaacccaattgtgacagaaaaggacagtccagtcaacatagaagcagaacctccattcggagacagctacatcatcataggagtggaaccaggacaattgaagctggactggttcaggaaaggaagttccatcggccaaatgtttgagacaacaatgaggggagcgaaaagaatggccatcttgggcgacacagcctgggattttggatctctgggaggagtgttcacatcaataggaaaagctctccaccaggtttttggagcaatctacggggctgctttcagtggggtctcatggactatgaagatccttataggagttatcatcacatggataggaatgaactcacgcagcacatcactgtctgtgtcactggtattagtgggaatcgtgacactgtacttgggagttatggttcaagccgatagtggttgcgttgtgagctggaagaacaaagaactaaaatgtggcagtggaatattcgtcacagataacgtgcatacatggacagaacaatacaagttccagccagaatccccttcaaaactggcttcagccatccagaaagctcacgaagaaggcatctgtggaatccgctcagtaacaagactggaaaatcttatgtggaaacagataacatcagaattgaatcatattctatcagaaaatgaagtgaaactgaccatcatgacaggagacatcaaaggaatcatgcaggtaggaaaacgatctctgcggcctcaacccactgagttgaggtattcatggaaaacatggggtaaagcgaaaatgctctccacagaactccacaatcagactttcctcattgatggtcccgaaacagcggaatgccccaacacaaacagagcttggaattcactagaagttgaggactatggctttggagtattcactactaatatatggctaagactgagagaaaagcaggatgtattttgtgactcaaaactcatgtcagcggccataaaggacaacagagccgtccatgctgatatgggttactggatagaaagcgcactcaatgatacatggaagatagagaaagcttctttcattgaagtcaaaagttgccactggccaaagtcacacactctatggagtaatggagtgctagaaagcgagatggtaattccaaagaatttcgctggaccagtgtcacaacataataacagaccaggctatcacacacaaacagcaggaccttggcatctaggcaagcttgagatggactttgatttctgcgaagggaccacagtggtggtaaccgaggaatgtggaaacagagggccttctttaagaacaaccactgcctcaggaaaactcataacggaatggtgttgccgatcttgcacactaccaccactaagatacagaggtgaggatggatgctggtacgggatggaaatcagaccattgaaagagaaagaagaaaatctggtcagttctctggtcacagccggacatgggcagatcgacaatttctcattaggaattctgggaatggcactgttccttgaagaaatgctcaggactcgagtaggaacgaaacatgcaatactactagtcgcagtttctttcgtaacgttaatcacagggaacatgtcttttagagacctgggaagagtgatggttatggtgggtgccaccatgacagatgacataggcatgggtgtgacttatcttgctctactagcagccttcaaagtcagaccaacctttgcagctggactgctcttgagaaaactgacctccaaggaattaatgatgaccaccataggaatcgttcttctctctcagagtagcataccagagaccattcttgagctgaccgatgcgttagctttaggcatgatggtcctcaagatggtgagaaacatggaaaaatatcagctggcagtgactatcatggctattttgtgtgtcccaaatgctgtgatattacagaacgcatggaaagtgagttgcacaatactggcagtggtgtctgtctcccccctgctcttgacatcctcacaacagaaagcggactggataccattagcgttgacgatcaaaggcctcaatccaacagccatttttctaacaaccctctcaagaactagcaagaaaaggagctggcctttaaacgaggccatcatggcggttgggatggtgagtatcttggccagctctctcttgaagaacgacatccccatgacaggaccattagtggctggagggcttcttactgtgtgctacgtattaactgggcggtcagccgatctggaactggagagagctaccgatgtcaaatgggatgaccaggcagagatatcaggtagcagtccaattctgtcaataacaatatcagaagatggcagcatgtcgataaagaatgaagaggaagagcaaacactgactatactcattagaacaggattgcttgtgatctcaggactctttccggtatcaataccaattacagcagcagcatggtacctgtgggaagtaaagaaacaacgggctggagtgttgtgggatatcccctcaccaccacccgtgggaaaggctgaattggaagatggagcctacagaatcaagcaaaaaggaatcctgggatattcccagatcggagctggagtttacaaagaaggaacatttcacaccatgtggcacgtcacacgtggcgctgtcctaatgcataaggggaagaggatcgaaccgtcatgggcggacgtcaagaaagacttaatatcatatggaggaggttggaagctagaaggagaatggaaagaaggagaagaagtccaggtcttggcattggagcctgggaaaaatccaagagccgtccaaacaaaacctggcctttttagaaccaatactggaaccataggtgccgtatccctggacttttcccccgggacgtcaggatctccaatcgttgacaaaaaaggaaaagttgtaggcctctatggcaatggtgtcgttacaaggagtggagcatatgtgagtgccatagctcagactgaaaaaagcattgaagacaatccagaaattgaagatgacatctttcgaaagagaagattgactatcatggatctccacccaggagcaggaaagacaaagaaatacctcccggccatagtcagagaggccataaaaagaggcttgagaacactaatcctagcccccactagagtcgtggcagctgaaatggaggaagcccttagaggacttccaataagataccaaactccagccatcagggctgagcacaccgggcgggagatcgtggacttaatgtgtcatgccacatttaccatgaggctgctatcaccaatcagagtgccaaattacaacctgatcatcatggacgaagcccattttacagatccagcaagcatagcagctaggggatacatctcaactcgagtggagatgggtgaggcagctggaatttttatgacagccactcctccgggtagcagagatccatttcctcagagtaatgcaccaattatggacgaagaaagagaaattccggaacgttcatggaactccgggcacgagtgggtcacggattttaaaggaaagactgtctggtttgttccaagcataaaaaccggaaatgacatagcagcctgcctgagaaagaatggaaagagggtgatacaactcagtaggaagacctttgattctgaatacgtcaagactagaaccaatgactgggatttcgtggttacaactgacatttcggaaatgggtgctaactttaaagctgagagggttatagaccccagacgctgcatgaaaccagttatactgacagacggcgaagagcgggtgattctggcaggacccatgccagtgacccactccagtgcagcacaaagaagagggagaataggaaggaatccaaggaatgaaaatgatcaatacatatatatgggagaacccctggaaaatgatgaagactgtgcgcactggaaggaagctaagatgctcctagataacatcaacacacctgaaggaatcattcccagcatgttcgagccagagcgtgaaaaggtggatgccattgacggtgaatatcgcttgagaggagaagcacggaaaacttttgtggacctaatgagaagaggagacctaccagtctggttggcttataaagtggcatctgaaggtatcaactacgcagacagaagatggtgttttgacggaaccagaaacaatcaaatcttggaagaaaatgtggaagtggaaatttggacaaaggaaggggaaaggaaaaaattgaaacctagatggttagatgctaggatctactccgacccactggcgctaaaagaattcaaggaattcgcagccggaagaaagtccctaaccctgaacctaatcacagagatgggcagactcccaacttttatgactcagaaggccagagatgcactagacaacttggcggtgctgcacacggctgaagcgggtggaaaggcatacaatcatgctctcagtgaactaccggagaccctggagacattgcttttgctgacactgttggccacagtcacgggaggaatctttctattcctgatgagcggaaggggtatagggaagatgaccctgggaatgtgctgcataatcacggccagcatcctcttatggtatgcgcaaatacaaccacattggatagcagcttcaataatattggagttctttctcatagtcttgctcattccagaaccagaaaagcagaggacaccccaggataaccaattgacttatgtcatcatagccatcctcacagtggtggccgcaaccatggcaaacgaaatgggttttctagaaaaaacaaagaaagacctcggactgggacacattgcaactcagcaacctgagagcaacattctggatatagatctacgtcctgcatcagcatggacgttgtatgccgtggctacaacatttatcacaccaatgttgagacatagcattgaaaattcctcagtaaatgtgtccctaacagccatagctaaccaagccacagtgctaatgggtctcgggaaaggatggccattgtcaaagatggacattggagtccccctccttgccattgggtgttactcacaagtcaaccctataaccctcacagcggctcttcttttattggtagcacattatgccatcattggaccgggacttcaagccaaagcaaccagagaagcccagaaaagagcagcagcgggcatcatgaaaaacccaactgtggatggaataacagtgatagatctagatccaataccctatgatccaaagtttgaaaagcagttgggacaagtaatgctcctagtcctttgtgtgacccaagtgctgatgatgaggactacgtgggctttgtgtgaagccttaactctagcaaccggacccgtgtctacattgtgggaaggaaatccagggagattctggaacacaaccattgcagtgtcaatggcaaacatctttagagggagttaccttgctggagctggacttctcttttctatcatgaagaacacaactagcacgagaagaggaactggcaacataggagaaacgctaggagagaaatggaaaagcagactgaacgcattggggaaaagtgaattccagatctacaaaaaaagtggaattcaagaagtggacagaaccttagcaaaagaaggcatcaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattgaagaatgtaagagaagttaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggctgaacaataacactcaattttgcgtaaaggttcttaacccgtacatgccctcagtcattgaaagaatggaaaccttacaacggaaatacggaggagccttggtgagaaatccactctcacggaattccacacatgaaatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaacattggaattgaaagtgagacaccgaacctagacataattgggaaaagaatagaaaaaataaaacaagagcatgaagcgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcccttcggacaacagcgcgtcttcaaagagaaggtggatacgagaacccaagaaccaaaagaaggcacaaaaaaactaatgaaaatcacggcagagtggctctggaaagaactaggaaagaaaaagacacccagaatgtgcaccagagaagaattcacaaaaaaggtgagaagcaatgcagccttgggggccatatttaccgatgagaacaagtggaagtcggcgcgtgaggctgttgaagacaataggttttgggagctggttgacaaggaaagaaacctccatcttgaaggaaaatgtgaaacatgtatatacaacatgatgggaaaaagagagaaaaaactaggagagtttggtaaagcaaaaggcagcagagctatatggtacatgtggcttggagcacgcttcttagagtttgaagccctaggatttttgaatgaagaccattggttctctagagagaactccctgagtggagtggaaggagaagggctgcataaactaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtaccaaaacaaggtggtgcgtgtgcaaagaccaacaccaagaggcacggtaatggacatcatatcgagaagagaccaaaggggtagtggacaagttggcacctatggcctcaacactttcaccaacatggaagcacaactaattaggcaaatggagggggaaggaatcttcaaaagcatccagcacttgacagcctcagaagaaatcgctgtgcaagattggctagtaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtgcccttctgttcacaccattttcacgaattaatcatgaaagatggtcgcatactcgtagtcccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaactagccggacaacctggtccatacacgccagccatgaatggatgacgacggaagacatgttgacagtttggaatagagtgtggatcctagaaaatccatggatggaagacaaaactccagtggaatcatgggaagaaatcccatacctgggaaaaagagaagaccaatggtgcggctcgctgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtggtag

SEQ ID NO: 730 - DNA, 10176 bp, Dengue virus
atgaataaccaacgaaaaaaggcgagaaatacgcctttcaatatgctgaaacgcgagagaaaccgcgtgtcaactgtgcagcagctgacaaagagattctcacttggaatgctgcagggacgaggaccattgaaactgttcatggccctggtggcattccttcgtttcctaacaatcccgccaacagcagggatattaaaaagatggggaacaatcaaaaaatcaaaggctatcaatgtcttgagagggttcaggaaagagattggaaggatgctgaacatcttgaacaggagacgcagaactgcaggtgtaatcattatgatgattccaacagtggtggcgttccatttaaccacacgcaacggagaaccacacatgatcgtcagtagacaagagaaagggaaaagtcttctgtttaaaacagagaacggtgtgaacatgtgcacccttatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgacaaaaacggaagccaaacatccagccactttaaggaagtattgtatagaggcaaagctgaccaacacaacaacagcatctcgctgcccaacacaaggagaacccagcctaaatgaagaacaggacaaaaggtttgtctgcaaacactccatggttgacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaggtaacaccacagagttccattacagaagcagaactgacaggttatggcaccgtcacgatggaatgctctccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagttacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgcctttagcggggtttcatggactatgaaaatcctcataggagttgtcatcacatggataggaatgaattcacgcagcacctcactgtctgtgtcactagtattagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagttgaagtactcttggaaagcatggggtaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcacttaatgacacatggaagattgagaaagcctctttcattgaagttaaaagctgccattggccaaagtcacacactctctggagtaatggagtgctagaaagtgagatgataattccaaagaattttgcaggaccagtgtcacagcacaactacagaccaggctatcatacacaaacggcaggaccctggcacctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcaggccattgaaagagaaagaagagaacttggtcaactctttggtcacagccggacatggacagattgacaacttctcactaggagtctggggaatggcattgttcctggaagaaatgctcaggacccgcgtaggaacgaaacatgcaatattgctagttgcagtttctttcgtgacattgatcacagggaacatgtcttttcgagatttggggagagtgatggtcatggtgggcgctactatgacggatgacataggcatgggcgtgacttatcttgccctactagcagccttcaaagtcagaccaacttttgcagctggactactcttgagaaagctgacctccaaggaattaatgatgaccaccataggaatcgtactcctctctcagagcaccataccagagactatacttgaactgactgacgcgctggctttggggatgatggttctcaaaatagtgagaaacatggaaaagtatcaactagcagtgactatcatggccatcttgtgcgtcccaaatgcagtgatattacaaaacgcatggaaagtgagctgcacaatactggcagtggtgtccgtttccccactgcttttaacatcatcacagcagaaagcagattggataccactggcgttgacgatcaaaggcctcaatccaacagccattttcttaacaaccctctcaagaactagcaagaaaaggagctggccactaaatgaggctattatggcagtcgggatggtgagcattttagctagttccctcttgaagaatgatattcccatgacaggaccattagtagctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattaggacaggactgctggtgatatcaggacttttccctgtgtcaataccaatcacggcagctgcatggtatctgtgggaagtgaaaaaacaacgagctggagtattgtgggatgtcccttcacccccacctgtgggaaaggccgaactggaagatggagcctatagaatcaagcagaaagggattctaggatactcgcagatcggggctggagtttacaaagaaggaacattccacacaatgtggcacgtcacacgcggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaaccataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacactaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctaatcatcatggatgaagcccatttcacagacccagcaagcatagcagctagaggatacatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgaatgggtcacggattttaaagggaagactgtttggtttgttccaagcataaaagcaggaaatgatatagcagcttgcctgagaaagaatgggaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagtatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaattacgcagacagaagatggtgctttgatggagtcaagaacaatcaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcactagacaacttagcagtcctgcatacggctgaagcaggcggaagggcgtacaatcatgctcttagtgaactgccggagaccctggagacattgcttttactgacactcttggccacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaggcattgcaacccagcaacctgagagcaacatcctggacatagatctacgtcctgcatcagcttggactctatatgctgtggcaacaactttcatcacaccaatgctgagacacagcattgaaaattcctcagtgaatgtgtctctaacggccattgctaaccaagctacagttttaatgggtcttgggaaaggatggccattgtcaaaaatggacatcggagttccccttctcgctatcgggtgctattcacaagttaaccccataactctcacggcggcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgactgggcccatctccacactgtgggaaggaaatccagggagattttggaatacaactattgcagtatcaatggctaacatttttagagggagctacctggccggagccggacttctcttttctatcatgaagaatacggccaacacaagaaggggaactggcaacacaggagagacgcttggagaaaaatggaaaaaccgattgaatgcattggggaagagtgaattccagatctataagaaaagtggaatccaggaggtggatagaaccctagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagggggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagcggaacccgcaacatcggaattgaaagtgagataccaaatttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaattaggaaagaaaaagacacctaggatgtgcaccagagaagaattcacaagaaaggtgaggagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaagagaagggctgcacaaactaggctacattttaagagacgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcagctgacagccacagaagaaattgcagtgaaaaactggttagcaagagtgggacgtgagaggttatcaagaatggctatcagtggagatgattgtgttgtgaaacccttagatgataggtttgcaagcgctctaacagctctaaatgacatgggaaaagttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtctctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccacacatgagtggatgacaacagaagatatgctgacagtctggaacagggtgtggattcaagaaaacccatggatagaagacaaaactccagtagaatcatgggaggaaatcccatatttggggaaaagagaagaccaatggtgcggctcattgatcgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 731 - DNA, 10176 bp, Dengue virus
atgaataaccaacgaaaaaaggcgagaaatacgcctttcaatatgctgaaacgcgagagaaaccgcgtgtcaactgtgcagcagctgacaaagagattctcacttggaatgctgcagggacgaggaccattgaaactgttcatggccctggtggcattccttcgtttcctaacaatcccgccaacagcagggatattaaaaagatggggaacaatcaaaaaatcaaaggctatcaatgtcttgagagggttcaggaaagagattggaaggatgctgaacatcttgaacaggagacgcagaactgcaggtgtgatcatcatgatgattccaacagtggtggcgttccatttaaccacacgcaacggagaaccacacatgatcgtcagtagacaagagaaagggaaaagtcttctgtttaaaacagagaacggtgtgaacatgtgtaccctcatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaagagatcagtggcactcgttccacatgtgggaatgggactggagacacgaactgaaacatggatgtcatcagaaggagcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgacaaaaacggaagccaaacatcccgccactttaaggaagtattgtatagaggcaaagctgaccaacacaacaacagcatctcgctgcccaacacaaggagaacccagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaagtaacaccacagagttccattacagaagcagaactgacaggctatggcactgtcacgatggaatgctctccgagaacgggcctcggctttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttattgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagttacatcattataggagtagaaccgggacaactgaagctcagctggtttaagaaaggaagctctattggccaaatgtttgagacaacaatgagaggagcgaagagaatggccattttaggtgacacagcttgggattttggatccctgggaggagtgttcacatctataggaaaggccctccaccaagtctttggagcaatctatggggctgcctttagcggggtttcatggactatgaaaatcctcataggagtcgtcatcacatggataggaatgaattcacgcagcacctcactgtctgtgtcactagtattagtgggggtcgtgacattgtatttgggagtcatggtgcaggccgatagtggttgcgttgcgagttggaaaaacaaagaactgaaatgtggtagtgggatttttatcacagacaacgtgcacacatggacagaacaatacaaattccagccagaatccccttcaaagctggcttcagcaatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcactagaagttgaagactatggctttggagtatttaccaccaacatatggctgaaactgaaagaaaggcaggatgtattttgtgactcaaaactcatgtcagcagccataaaagacaacagggccgtccacgccgatatgggttattggatagaaagcgcacttaatgacacatggaagattgagaaagcctcttttattgaagttaaaagctgccactggccaaagtcacacactctctggagtaatggagtgctagaaagtgagatgataattccaaagaattttgcaggaccagtgtcacagcacaactacagaccaggctatcatacacaaacggcaggaccctggcatctaggtaagcttgagatggactttgatttttgtgaaggaaccacagtggtagtgactgaggactgtggaaatagaggaccctctttaagaacaactactgcttctggaaaactcataacagaatggtgctgccggtcttgcacattaccaccgctaaggtacagaggtgaggatggatgctggtatggaatggaaatcaggccattgaaagagaaagaagagaacctggtcaactctttggtcacagccggacatggacagattgacaacttctcactaggagtcttgggaatggcattgttcctggaagaaatgctcaggacccgcgtaggaacgaaacatgcaatattgctagttgcagtttctttcgtgacattgatcacagggaacatgtcttttcgagatttggggagagtgatggttatggtgggcgccactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatactcgaactgactgacgcgctggctttggggatgatggttctcaaaatagtgagaaacatggaaaagtatcaactagcagtgactatcatggccatcttgtgcgtcccaaatgcagtgatattgcaaaacgcatggaaagtgagctgcacaacactggcagtggtgtccgtttccccactgcttttaacatcctcacagcagaaagcagattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtagctggagggcttctcactgtgtgttacgtgctcactggaagatcggctgatttggaactggagagagctgctgacgtaagatgggaagaacaggcagagatatcgggaagtagtcaaattctgtcaataacaatatcggaagatggtagcatgtcgataaaaaatgaagaagaagaacaaacactgaccatactcattaggacaggactgctggtgatatcaggactttttcccgtgtcaataccaatcacggcagctgcatggtacctgtgggaagtgaaaaaacaacgagccggagtattgtgggatgtcccttcacccccacctgtgggaaaggccgaactggaagatggagcctatagaatcaagcagaaagggattctaggatactcgcagatcggggctggagtttacaaagaaggaacattccacacaatgtggcacgtcacacgcggtgctgtcctaatgcataaagggaagagacttgaaccatcatgggcggacgtcaagaaagacctaatatcgtatggaggaggctggaagctagaaggggaatggaaggaaggagaagaagtccaggtcctggcattagagcctggaaagaatccaagagccgtccaaacaaaacccggtctcttcaaaactaacactggaaccataggcgccgtatctctggacttttctcctggaacgtcaggatctccaatcgtcgacaaaaaaggaaaagttgtgggcctttatggcaacggcgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacactaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctgatcatcatggatgaagcccatttcacagacccagcaagcatagcagctagaggatacatttcaactcgagttgagatgggtgaagcagctgggatttttatgacagctactcctcctggaagcagagacccatttcctcagagcaatgcaccaatcatggatgaagaaagggaaatccctgagcgctcgtggaattctggacatgaatgggttacggattttaaagggaagactgtttggtttgttccaagtataaaagcaggaaatgatatagcagcttgcctgagaaagaatggaaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagtatgttcgaaccagagcgtgaaaaggtggatgccattgatggtgaataccgcttaagaggagaagcgaggaaaacttttgtggacctaatgagaagaggagacctaccagtctggctagcctatagagtggcagctgaaggtatcaactacgcagacagaagatggtgctttgatggagtcaagaacaatcagatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctcaccctgaatctaatcacagagatgggtaggctcccaaccttcatgactcagaaagcaaggaacgcactagacaacttagcagtcctgcatacggctgaagcaggcggaagggcgtacaatcatgctcttagtgaactgccggagaccctggagacattgcttttactgacactcttggccacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaagacaaagaaagacttcggattgggaagcattgcaacccagcaacctgagagcaacatcctggacatagatctacgtcctgcatcagcttggactctatatgctgtggcaacaactttcatcacaccaatgctgagacacagcattgaaaattcctcagtgaatgtgtctctaacggccattgccaaccaagccacagttttaatgggtcttgggaaaggatggccattgtcaaaaatggacatcggagttccccttctcgctatcgggtgctattcacaagttaaccccataactctcacggcagcccttctcttattggtagcacattatgccatcatagggccaggactccaagcgaaagcaactagagaagctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctttaaccttagcgactgggcccatctccacactgtgggaaggaaatccagggagattttggaatacaactattgcagtatcaatggctaacatttttagagggagctacctggccggagccggacttctcttttctatcatgaagaatacggccaacacaagaaggggaactggcaacacaggagagacgcttggagaaaaatggaaaaaccgattgaatgcattggggaagagtgaattccagatctacaagaaaagtggaatccaggaggtggatagaaccttagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagggggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagcggaacccgtaacatcggaattgaaagtgagataccaaacttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaattaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagaagtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcacctgacagtcacagaagaaattgcagtgaaaaactggttaacaagagtggggcgtgagaggttatcaagaatggctatcagtggagatgattgtgttgtgaaacccttagatgataggtttgcaagcgctctaacagctctaaatgacatgggaaaagttaggaaagacatacaacaatgggaaccttcaagaggatggaacgattggacacaagtgcccttttgttcacaccatttccatgagttaatcatgaaggacgggcgtgtactcgtagttccatgcagaaaccaagatgaactgattggtagggcccgaatttcccagggagccgggtggtctttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccacacatgagtggatgacaacagaagatatgctgacagtctggaacagggtgtggattcaagaaaacccatggatggaagacaaaactccagtagaatcatgggaggaaatcccatatttggggaaaagagaagaccagtggtgcggctcattgatcgggctaacaagcagggccacttgggcaaagaacatccaaacagcaataaatcaagttagatccttaataggcaatgaggaatacacagactacatgccatccatgaaaaggttcagaagagaagaggaagaggcaggagtcttgtggtag

SEQ ID NO: 732 - DNA, 10176 bp, Dengue virus
atgaataaccaacggaaaaaggcgagaaatacgcctttcaatatgctgaaacgcgagagaaaccgcgtgtcaacaatacaacagttgacgaagagattctcacttggaatgctgcaggggagagggccattaaagctatttatggccctagtggcgttccttcgtttcctaaccattccaccaacagcagggatactgaagagatggggaacgatcaaaaaatcaaaggctatcagtgtactgagaggatttagaaaggaaattgggaggatgctgaacattttgaacaggagacgcagaacagcgggcttcctcatcatggtcattccaacagtgatggctttccatttgaccacacgcaatggggagccacacatgattgtcagcaagaatgagaaaggaaagagcctcctttttaaaacagagaatggaataaacatgtgcacccttatggccatggatttaggcgagttgtgcgaggacaccgttacatacaagtgtccctttctcaagcaaaacgagccggaggacatagactgctggtgcaattccacatcaacctgggtgacgtacgggacgtgtagctcgacaggagagcataggagggagaaaaggtcagtcgcacttgtcccacacgtaggaatggggctggaaacgagaactgaaacatggatgtcatcagaaggagcatggaaacaagcccagcggattgagacatggattctgaggcacccaggtttcactcttatggcagctgttttggcgtacacaatagggacaacacatttccaaagagccctaatctttatccttttaactgccgttgctccctcaatgacaatgcgatgtataggcatatcgaaccgagactttgtagagggagtttcaggaggaagctgggttgatattgtcttagaacatgggagctgcgtcacaacaatggccaagaacaaaccaacattagactttgaactaataaaaacagaggccaagcaaccagcaacattgagaaaattctgcattgaagccaaattgaccaacacaacaacagaatctcgctgcccaacccaaggtgaacccagcctagtagaggagcaggacaaaagattcgtttgcaggcattcgatggtggatagaggttggggtaatggatgtggtctgtttgggaaaggaggcattgtgacctgtgcgatgttcacatgcttgaagaaaatggagggaaaagttgtgcagccagaaaacctagagtacaccatagtcataacaccccattcaggagaggaacatgctgtggggaatgatacagggaagcacggcaaggaggttaaaataacaccccaaagatctattgctgaagctgaactaacagattatggcacgatcacgatggaatgctccccacgaacaggtctcgattttaacgagatggtcctgctgcagatggagagcaaagcttggctagtccatagacagtggtttctggacttacctctaccatggcttcctggagcagacacacaagggtccaattggatccagaaagagatgctagtaacattcaaaaatccccatgcgaaaagacaagacgttgtcgtcttgggatcgcaagagggcgccatgcacacagcactcacaggagcaacagaaattcaaatgtcattaggaaacatactatttatggggcatttgaagtgtagactgaggatggacaagctgcaactcaaagggatgtcgtactctatgtgcacaggaaagttcaaagttgtcaaagagatagcggaaacacaacatggaacaatagtcatcagagtgcagtatgaaggagatgactcaccatgcaagattccttttgagatcatggacttggaaaagaaacatgttttagggcgattgatcacggtcaacccaatagtgacagagaaagacaatccaatcaacatagaagcagaacctccatttggtgatagctacattgtcataggagtggagccaggacagctgaaattaaactggtttaaaaaaggaagctctataggacaaatgtttgaaacaacaatgagaggagctaaaagaatggccatcttgggagacacagcttgggactttggatccatagggggagtgttcacatcagtagggaaagcactacatcaagtttttggcgcaatctatggcgccgcctttagcggggtttcatggactatgaagatcctcataggggtggttataacatggataggaatgaattcccgcagcacttccctgtcagtgaccctggcgttagtaggaatcgtgacactatacctgggagtgatggtgcaagcggacagtggttgtgttgtaagctggaagaacaaagaactgaaatgtggaagtgggatctttgtaactgacaatgtgcacacttggacggaacaatacaaatttcaaccagactccccttcaaagctggcttccgcaattcaaaaagctcatgaggaaggaatctgtggaatccgttcagtgacaaggttggagaatctgatgtggaagcagataacaccagaattgaaccacatcctatccgaaaatgaagtcaaactgaccatcatgacaggagagattaaggggattatgcaagcagggagaagatctttgaaaccccaacctactgagctgagatactcatggaaaacttggggaaaggcgaaggtactatcaacagaactccaaaatcaaactttcctcatagacggtcctgaaacaactgaatgccctaatagcaatagagcctggaactctttggaagttgaggattatggctttgggatttttaccactaacatatggctaaagttgagagagaaacaagacatgatttgtgattcaaagttgatgtcagcagctgttaaggacgacagagcagttcatgctgatatgggctattggatagagagcagactgaatgacacatggaagatggaaaaagcatcatttattgaggttaaaagttgctactggccaagatcacacaccctttggagcaacggagtgctggagagtgaaatgataattccaaagaatctggctggaccagtgtcgcagcacaactacagaccaggctattatacgcaaacagccggaccatggcatttgggcaaactcgagatggatttcgagttttgtgaaggaaccacggtagtggtgaccgaggattgcggaaacagaggaccatccttgagaacaaccactgcctcaggaaaactcataactgagtggtgctgcagatcatgcacactaccaccactaagatatagaggagaggatggatgttggtacggaatggaaattagaccactgaaagaaagagaagagaacctggtgaactcattggttacagccggacatggccaaattgacaatttttcactagggattctgggaatggcattgctcttggaagagatgcttagaaccagagtaggaacaaagcacgccttgctgctagtggcgatctccttcgtgacactgattacagggaatatgtccttcaaggatctaggaagagtgataattatggtgggagcagccatgacggacgagatgggtatgggcgtgacatacttggcattactagctgctttcagagtcagacctacctttgcagtggggttgcttttgagaaaacttacttcaaaggaattgttgatggcaaccatcggagtcgttctcctctctcagagtaacataccaggaacagttttggaactaactgatgcaatagcattgggaataatggttcttaaaatagtgaggagtatggaaaaataccagctggcagtgaccgtcatggctatgctatgtattccaaatgtcatgatactccagcatgcatggaaagtgggctgtaccatattggcagcagtttctgtatcaccactcctcttgacttcctcacaacaaaaaacggactggataccgttagtcctcacaataaaaggtctcaatccgactgctatcttcttaacaactctgtctagacccaataaaacaagaagttggcctctcaatgaagctatcatggcagttggaatggtgagcatactagctagttcccttctgaaaaatgacattccaatgacgggaccactggtggcaggaggacttctcacagtgtgctatgtgcttactggcagatcggcagacttggagctagagaaagccgcagaggtgaaatgggaagatcaagctgagatatctgggagtagcccaatcctatcagtcactatatcagaagatggtagtatgtcaataaagaatgaggaagaagaacagaccttaactatactgataaggacgggactgttagtaatatcaggactattcccagtatcaatcccaatcacagccgcggcctggtacttatgggagacaaaaaagcagagggccggagtgctgtgggacgttccttcacctccaccaatggaaaaagctgagctagaagatggcgcttacagaatcaaacagagagggattctcggatactctcaaattggagctggagtgtataaagaaggtacatttcacacgatgtggcacgtcacacgtggagctgtcctagtgcacaaagggaaaagaattgagccatcatgggcagacgtgaagaaagacttgatatcatatggaggaggctggaaactggaaggagagtggaaagaaggcgaagaagttcaggttttggcgctggaacctggaaaaaatccgagagcagtgcaaacaaaacccggcctcttcaaaaccaatacaggaacaataggagccgtatccttagacttctccccaggaacatcaggatccccaatcattgacaagaaaggaaaggtcgtgggtctctacggaaatggcgtcgtgacaagaagcggaatctatgtgagctccatagctcaaacagagaaaagcgtggaggacaatccagagattgaagatgatatatttcggaagaaaaggctaaccattatggacttacatccaggagcgggaaaaacaaagcgatacctcccagccatagttagagaagcaataagaagaggcctgagaacactgattctggcccccaccagagtagtggctgcagaaatggaggaagccctacgggggctcccaatccgttatcagactccagccatcaaggcagagcacacagggcgcgaaatcgtagacctaatgtgtcatgccacattcaccatgaggttactgtcaccaattagggtaccaaactacaacttaatcataatggatgaagctcatttcacagacccagctagcatagcagctcgaggatacatctccacccgagtagaaatgggagaagctgctggaatatttatgacagccactcctccaggcagcagggacccttttccacagagcaacgccccaatagtggacgaggaaagagagattcccgaacgctcatggaattccggacatgaatggataacaaactttaaaggcaaaacagtatggtttgtcccgagcataagagctggaaacgacatagcagcctgcttaaggaaaaatgggaaaagagtgattcagctaagtaggaaaacctttgacacagaatacatcaaaacaagaacaaatgactgggacttcgtagtcacgactgacatctcagaaatgggggcaaacttcaaagctgaaagagtgatagatccaaggagatgtatgaagccagttatactgacagatggtgaagagcgtgtggttctggcaggacccatgccagtcactcactcaagtgcagcacagagaagagggagaataggaaggaatccaaaaaatgagaatgaccaatatatctacatgggagaacctttagagaatgatgaagactgtgctcactggaaggaggcaaagatgctccttgataacatcaacacacctgaaggtatcatccccagcatgttcgagccagaacgtgagaaagttgatgccatagacggtgaataccggctaaggggggaagcaaggaagacttttgtggacctgatgaaaagaggagacctaccagtttggctggcttacaaagtagcctcggaaggcataagctatgcagacaggaagtggtgctttgatggaatcagaaataatcagatcctggaggagaacatggaagtggaagtttggacgaaagaaggtgagaggaaaaaactaaaacccagatggttggatgcaagaacttactcagatccgctagcacttaaagagttcaaggaatttgcggccggaaggaagtctctaactctgagtttgatcacagaaatgggtcggctcccaaccttcatgacccaaaagacaagagatgccctggacaacttggctgtactgcactctgcagaaatgggtggaagagcctataaccatgctctcagtgaattgccagaaactttagaaacattactcctgctaggtctcctggccacagtcacagggggaatctttttgttcttgatgagtggaagaggtgtagggaaaatgaccctcggaatgtgttgcataatcacggccagcggccttctgtggtatgcacagatacagccccattggattgcagcctcaataatactagagttctttctcatagtactgctaatccctgaaccagagaagcaaagaacaccccaggacaaccagttgacctatgtggtcatagccatcctgacattagtggcagccaccatggcaaacgaaatgggttttctagaaaagacaaagaaagaccttgggttgggaggtattacaatgcaacaaccagaaataaatatcttggacatagacctccgacctgcatcagcgtggacactatatgcagtggctactacgtttgtcacgccaatgctgaggcacagcatagaaaactcctcagtgaatgtgtcactaacagctatagcaaatcaggccacggtgcttatgggcttgggaaaaggttggccactatcaaaaatggacataggagttcctcttcttgccattggatgctactcgcaggtgaatcccataaccctcacagcagcactactgctgttagtggcacactatgccatcataggccctggactccaagcaaaggctaccagagaggcgcagaaaagagcagcagccggcatcatgaagaatccaacagtagatgggattacagtgattgacttagaaccaataccctatgatccgaagtttgagaagcagttagggcaagtgatgctcttggtcctttgtgtgacacaggtgctgatgatgagaaccacgtgggctctatgcgaagccctaaccctagcaacagggcccatatcaacactgtgggaaggaaatccagggaaattctggaacacaacaatagcagtctctatggccaacattttcagagggagttatttggctggagctggactccttttttccatcatgaggaacacaaccagcgcacgaagaggaaccggcaccataggtgaaactttaggagaaaaatggaagagttggctaaatgcactgggaagaagtgaattccagatatacaagaaaagtgggattcaggaggtagacagaaccctggcgaaggaaggcataaagagaggagaaacagaccaccatgccgtttcacggggctctgcaaagctgagatggtttgttgaaagaaacatggtcgccccagaaggaaaggtagtagaccttggttgtggcagaggaggatggtcatattactgtggtggactaaaaaatgtgagagaagtcaaaggcctgacgaaaggaggaccaggacatgaggagcctatacctatgtcaacatacgggtggaatctagtacgactgcagagtggagtggatgtattctttactccaccagagagatgcgacacactgctatgcgacataggagaatcgtcaccaaaccccacagtggaggccggacgaacactgagagttctcaatctagtagaaaattggctggggagcaacacacagttttgcgtaaaagtcctcaacccttacatgccatcagtcatagagagaatggaagcactacagagaaagtttggaggcgctctagttcgcaatccactctcaaggaattccacgcatgagatgtactgggtgtccaacgcttctggaaatattgtgtcttctgtgaacatgatttcaaggatgttgataaatagattcacaatgaggcacaagaaagccacctacgagcctgatgttgatcttggaagtggaacacgcaacattggaattgagtgtgagacgccaaatatggacataattggaaaacggattgagaaaataaaacaagaacatgaaacgtcatggcactatgaccaagatcatccatacaaaacatgggcataccacggcagttatgagacgaaacaaacaggatcagcatcatcaatggtaaacggagtggtcaggctgttgaccaaaccctgggatgtcattcccatggtgacgcaaatggcaatgacagacacaaccccctttggacagcagcgtgttttcaaggaaaaagtagacacaagaacccaggaaccaaaagaaggcacgaaaaaattgatgagaatcacagcaaagtggctttggggtgagttaggaagaagaaagaagcccagaatctgcacaagagcagagttctgcaacaaagtgagaagcaacgcagctctgggggctgtgttcactgatgagaacaagtggaagtcagcacgcgaagcggtcgaagatgaaagattttgggaactggtggaaaaagagagaaaccttcaccttgacggaaagtgtgaaacatgtgtgtacaacatgatgggaaaaagagagaagaaactgggagaattcggcaaagcaaaaggcagcagagccatatggtacatgtggctaggtgcccgctttttggagtttgaggccctaggttttttgaacgaagaccattggttctctagagaaaactctctaagtggagtggaaggagaaggactgcacaagctgggctacatcctaagagacattagcagaaaagcaggaggagcaatgtacgcagatgacactgctggttgggacacaaggatcacatctgaggatctaaagaatgaagaaatgataacagaccaaatggaagggagacataagaagctggcagaggccatattcaaattaacataccagaacaaggtagttcgcgtccaaagaccaaccccaagaggcacggtgatggatatcatttcaaggagagaccaaagaggcagtgggcaggtggggacgtacggtctcaataccttcaccaatatggaagcacaactgataaggcagatggaaggggaaggactctttaagagcatactgcatttaacaccccaagaggaaacagctgtccacgcttggctagttagagagggacgcgaacgcctcgcaagaatggcaatcagtggagatgactgcgtcgtgaaaccactagatgacagattcgccagagctttaacagcattgaatgacatgggaaaagtgaggaaagacatacaacagtgggaaccctcaaaaggatggagtgattggacccaagtgcccttttgctctcaccactttcatgaattaataatgaaagatggtcgcaagcttgtagtcccatgcagaaaccaggatgaactgataggcagagcgcgtatctcccagggggcaggatggtccttgagagagacagcctgtttggggaagtcatatgcccagatgtggagcctgatgtacttccacaggcgtgatctcaggttggctgctaatgccatatgttcagcagttccatcacattgggttccaactagcaggacaacttggtccatacatgctagtcatgaatggatgacgacggaagacatgttagcagtctggaacagggtgtggattcaggacaatccatggatggaagacaagacccccgtggaatcatgggaagacataccatacttagggaaaagggaggaccagtggtgtggttccctgattggcttaacaagcagggccacctgggcaaagaacattcaaacagccataaaccaagtcagagctctcattggtgaggaggaatacacggactacatgccctcaatgaaaaggttcaggagtgaagaggaggagtcaggagtcctgtggtaa

SEQ ID NO: 733 - DNA, 10176 bp, Dengue virus
atgaataaccaacgaaaaaaggcgagaaatacgcctttcaatatgctgaaacgcgagagaaaccgcgtgtcaacaatacaacagttgacgaagagattctcacttggaatgctgcaggggagagggccattaaagctatttatggccctagtggcgttccttcgtttcctaaccatcccaccaacagcagggatactgaagagatggggaacgatcaaaaaatcaaaggctatcagtgtactgagaggatttagaaaggaaattgggaggatgctgaacattttgaacaggagacgcagaacagcgggcttcctcatcatggtcattccaacagtgatggctttccatttgaccacacgcaatggggagccacacatgattgtcagcaagaatgagaaaggaaagagcctcctttttaaaacagagaatggaataaacatgtgcacccttatggccatggatttaggcgagttgtgcgaggacaccgttacatacaagtgtccctttctcaagcaaaacgagccggaggacatagactgctggtgcaattccacatcaacctgggtgacgtacgggacgtgtagctcgacaggagagcataggagggagaaaaggtcagtcgcacttgtcccacacgtaggaatggggctggaaacgagaactgaaacatggatgtcatcagaaggagcatggaaacaagcccagcggattgagacatggattctgaggcacccaggtttcactcttatggcagctgttttggcgtacacaatagggacaacacatttccaaagagccctaatctttatccttttaactgccgttgctccctcaatgacaatgcgatgtataggcatatcgaaccgagactttgtagagggagtttcaggaggaagctgggttgatattgtcttagaacatgggagctgcgtcacaacaatggccaagaacaaaccaacattagactttgaactaataaaaacagaggccaagcaaccagcaacattgagaaaattctgcattgaagccaaattgaccaacacaacaacagaatctcgctgcccaacccaaggtgaacccagcctagtagaggagcaggacaaaagattcgtttgcaggcattcgatggtggatagaggttggggtaatggatgtggtctgtttgggaaaggaggcattgtgacctgtgcgatgttcacatgcttgaagaaaatggagggaaaagttgtgcagccagaaaacctagagtacaccatagtcataacaccccattcaggagaggaacatgctgtggggaatgatacagggaagcacggcaaggaggttaaaataacaccccaaagctctattgctgaagctgaactaacagattatggcacgatcacgatggaatgctccccacgaacaggtctcgattttaacgagatggtcctgctgcagatggagagcaaagcttggctagtccatagacagtggtttctggacttacctctaccatggcttcctggagcagacacacaagggtccaattggatccagaaagagatgctagtaacattcaaaaatccccatgcgaaaagacaagacgttgtcgtcttgggatcgcaagagggcgccatgcacacagcactcacaggagcaacagaaattcaaatgtcattagggaacatactatttatggggcatttgaagtgtagactgaggatggacaagctgcaactcaaagggatgtcgtactctatgtgcacaggaaagttcaaggttgtcaaagagatagcggaaacacaacatggaacaatagtcatcagagtgcagtatgaaggagatgactcaccatgcaagattccttttgagatcatggacttggaaaagaaacatgttttagggcgattgatcacggtcaacccaatagtgacagagaaagacaatccaatcaacatagaagcagaacctccatttggtgatagctacattgtcataggagtggagccaggacagctgaaattaaactggtttaaaaaaggaagctctataggacaaatgtttgaaacaacaatgagaggagctaaaagaatggccatcttgggagacacagcttgggactttggatccatagggggagtgttcacatcagtagggaaagcactacatcaagtttttggcgcaatctatggcgccgcctttagcggggtttcatggactatgaagattctcacaggggtggttataacatggataggaatgaattcccgcagcacttccctgtcagtgaccctggtgttagtaggaatcgtgacactatacctgggagtgatggtgcaagcggacagtggttgtgttgtaagctggaagaacaaagaactgaaatgtggaagtgggatctttgtaactgacaatgtgcacacttggacggaacaatacaaatttcaaccagactccccttcaaagctggcttccgcaattcaaaaagctcatgaggaaggaatctgtggaatccgttcagtgacaaggttggaaaatctgatgtggaagcagataacaccagaattgaaccacatcctatccgaaaatgaagtcaaactgaccatcatgacaggagagattaaggggattatgcaagcagggagaagatctttgaaaccccaacctactgagctgagatactcatggaaaacttggggaaaagcgaaggtactatcaacagaactccaaaatcaaactttcctcatagacggtcctgaaacaactgaatgccctaatagcaatagagcctggaactctttggaagttgaggattatggctttgggatttttaccactaacatatggctaaagttgagagagaaacaagacatgatttgtgattcaaagttgatgtcagcagctgttaaggacgacagagcagttcatgctgatatgggctattggatagagagcagactgaatgacacatggaagatggaaaaagcatcatttattgaggttaaaagctgctactggccaagatcacacaccctttggagcaacggagtgctggagagtgaaatgataattccaaagaatctggctggaccagtgtcgcagcacaactacagaccaggctatcatacgcaaacagccggaccatggcatttgggcaaactcgagatggatttcgagttttgtgaaggaaccacggtagtggtgaccgaggattgcggaaacagaggaccatccttgagaacaaccactgcctcaggaaaactcataactgagtggtgctgcagatcatgcacactaccaccactaagatatagaggagaggatggatgttggtacggaatggaaattagaccactgaaagaaagagaagagaacctggtgaactcattggttacagccggacatggccaaattgacaatttttcactagggattctgggaatggcattgctcttggaagagatgcttagaactagagtaggaacaaagcacgccctgctgctagtggcgatctccttcgtgacactgattacagggaatatgtccttcaaggatttaggaagagtgataattatggtgggagcagccatgacggacgagatgggtatgggcgtgacatacttggcattactagctgctttcagagtcagacctacctttgcagtggggttgcttttgagaaaacttacttcaaaggaattgttgatggcaaccatcggagtcgttctcctctctcagagtaacataccaggaacagttttggaactaactgatgcaatagcattgggaataatggttcttaaaatagtgaggagtatggaaaaataccagctagcagtgaccgtcatggctatgctatgtattccaaatgtcatgatactccagcatgcatggaaagtgggctgtaccatattggcagcagtttctgtatcaccactcctcttgacttcctcacaacaaaaaacggactggataccgttagtcctcacaataaaaggtctcaatccgactgctatcttcttaacaactctgtctagacccaataaaacaagaagttggcctctcaatgaagctatcatggcagttggaatggtgagcatactagctagttcccttctgaaaaatgacattccaatgacgggaccactggtggcaggaggacttctcacagtgtgctatgtgcttactggcagatcggcagacttggagctagagaaagccgcagaggtgaaatgggaagatcaagctgagatatctgggagtagcccaatcctatcagtcactatatcagaagatggtagtatgtcaataaagaatgaggaagaagaacagaccttaactatactgataaggacgggactgttagtaatatcaggactattcccagtatcaatcccaatcacagccgcggcctggtacttatgggagacaaaaaagcagagggccggagtgctgtgggacgttccttcacctccaccaatggaaaaagctgagctagaagatggcgcttacagaatcaaacagagagggattctcggatactctcaaattggagctggagtgtataaagaaggtacatttcacacgatgtggcacgtcacacgtggagctgtcctagtgcacaaagggaaaagaattgagccatcatgggcagacgtgaagaaagacttgatatcatatggaggaggctggaaactggaaggagagtggaaagaaggcgaagatgttcaggttttggcgctggaacctggaaaaaacccgagagcagtgcaaacaaaacccggcctcttcaaaaccaatacaggaacaataggagccgtatccttagacttctccccaggaacatcaggatccccaatcattgacaagaaaggaaaggtcgtgggtctctacggaaatggcgtcgtgacaagaagcggaacctatgtgagctccatagcccaaacagagaaaagcgtggaggacaatccagagattgaagatgatatatttcggaagaaaaggctaaccatcatggacttacatccaggagcgggaaaaacaaagcgatacctcccagccatagttagagaagcaataagaagaggcctgagaacactgattctggcccccaccagagtagtggctgcagaaatggaggaagccctacgggggctcccaatccgttatcagactccagccatcaaggcagagcacacagggcgcgaaatcgtagacctaatgtgtcatgccacattcaccatgaggttactgtcaccaattagggtaccaaactacaacttaatcataatggatgaagctcatttcacagacccagctagcatagcagctcgaggatacatctccacccgagtagaaatgggagaagctgctggaatatttatgacagccactcctccaggcagcagggacccttttccacagagcaacgccccaatagtggacgaggaaagagagattcccgaacgctcatggaattccggacatgaatggataacaaactttaaaggcaaaacagtatggtttgtcccgagcataagagctggaaacgacatagcagcctgcttaaggaaaaatgggaaaagagtgattcagctaagtaggaaaacctttgacacagaatacatcaaaacaagaacaaatgactgggacttcgtagtcacgactgacatctcagaaatgggggcaaacttcaaagctgaaagagtgatagatccaaggagatgtatgaagccagttatactgacagatggtgaagagcgtgtggttctggcaggacccatgccagtcactcactcaagtgcagcacagagaagagggagaataggaaggaatccaaaaaatgagaatgaccaatatatctacatgggagaacctttagagaatgatgaagactgtgctcactggaaggaggcaaagatgctccttgataacatcaacacacctgaaggtatcatccccagcatgttcgagccagaacgtgagaaagttgatgccatagacggtgaataccggctaaggggggaagcaaggaagacttttgtggacctgatgaaaagaggagacctaccagtttggctggcttacaaagtagcctcggaaggcataagctatgcagacaggaagtggtgctttgatggaatcagaaataatcagatcctggaggagaacatggaagtggaagtttggacgaaagaaggtgagaggaaaaaactaaaacccagatggttggatgcaagaacttactcagatccgctagcacttaaagagttcaaggaatttgcggccggaaggaagtctctaactctgagtttgatcacagaaatgggtcggctcccaaccttcatgacccaaaagacaagagatgccctggacaacttggctgtactgcactctgcagaaatgggtggaagagcctataaccatgctctcagtgaattgccagaaactttagaaacattactcctgctaggtctcctggccacagtcacagggggaatctttttgttcttgatgagtggaagaggtgtagggaaaatgaccctcggaatgtgttgcataatcacggccagcggccttctgtggtatgcacagatacagccccattggattgcagcctcaataatactagagttctttctcatagtactgctaatccctgaaccagagaagcaaagaacaccccaggacaaccagttgacctatgtggtcatagccatcctgacattagtggcagccaccatggcaaacgaaatgggttttctagaaaagacaaagaaagaccttgggttgggaggtattacaatgcaacaatcagaaataaatatcttggacatagacctccgacctgcatcagcgtggacactatatgcagtggctactacgtttgtcacgccaatgctgaggcacagcatagaaaactcctcagtgaatgtgtcactaacagctatagcaaatcaggccacggtgcttatgggcttgggaaaaggttggccactatcaaaaatggacataggagttcctcttcttgccattggatgctactcgcaggtgaatcccataaccctcacagcagcactactgctgttagtggcacactatgccatcataggccctggactccaagcaaaggctaccagagaggcgcagaaaagagcagcagccggcatcatgaagaatccaacagtagatgggattacagtgattgacctagaaccaataccctatgatccgaagtttgagaagcagttagggcaagtgatgctcttggtcctttgtgtgacacaggtgctgatgatgagaaccacgtgggctctatgcgaagccctaaccctagcaacagggcccatatcaacactgtgggaaggaaatccagggaaattctggaacacaacaatagcagtctctatggccaacattttcagagggagttatttggctggagctggactccttttttccatcatgaggaacacaaccagcgcacgaagaggaaccggcaccataggtgaaactttaggagaaaaatggaagagtcggctaaatgcactgggaagaagtgaattccagatatacaagaaaagtgggattcaggaggtagacagaaccctggcgaaggaaggcataaaaagaggagaaacagaccaccatgccgtttcacggggctctgcaaagctgagatggtttgttgaaagaaacatggtcgccccagaaggaaaggtagtagaccttggttgtggcagaggaggatggtcatattactgtggtggactaaaaaatgtgagagaagtcaaaggcctgacgaaaggaggaccaggacatgaggagcctatacctatgtcaacatacgggtggaatctagtgcgactgcagagtggagtggatgtattctttactccaccagagagatgcgacacactgctatgcgacataggagaatcgtcaccaaaccccacagtggaggccggacgaacactgagagttctcaatctagtagaaaattggctggggagcaacacacagttttgcgtaaaagtcctcaacccttacatgccatcagtcatagagagaatggaagcactacagagaaagtttggaggcgctctagttcgcaatccactctcaaggaattccacgcatgagatgtactgggtgtccaacgcttctggaaatattgtgtcttctgtgaacatgatttcaaggatgttgataaatagattcacaatgaggcacaagagagctacctacgagcctgatgttgatcttggaagtggaacacgcaacattggaattgagtgtgagacgccaaatatggacataattggaaaacggattgagaaaataaaacaagaacatgaaacgtcatggcactatgaccaagatcatccatacaaaacatgggcataccacggcagttatgagacgaaacaaacaggatcagcatcatcaatggtaaacggagtggtcaggctgttgaccaaaccctgggatgtcatccccatggtgacgcaaatggcaatgacagacacaaccccctttggacagcagcgtgttttcaaggaaaaagtagacacaagaacccaggaaccaaaagaaggcacgaaaaaattgatgagaatcacagcaaagtggctttggggtgagttaggaagaagaaagaagcccagaatctgcacaagagcagagttttgcaacaaagtgagaagcaacgcagctctgggggctgtgttcactgatgagaacaagtggaagtcagcacgcgaagcggtcgaagatgaaagattttgggaactggtggaaaaagagagaaaccttcaccttgacggaaagtgtgaaacatgtgtgtacaacatgatgggaaaaagagagaagaaactgggagaattcggcaaagcaaaaggcagcagagccatatggtacatgtggctaggtgcccgctttttggagtttgaggccctaggttttttgaacgaagaccattggttctctagagaaaactctctaagtggagtggaaggagaaggactgcacaagctgggctacatcctaagagacattagcagaaaagcaggaggagcaatgtacgcagatgacactgctggttgggacacaaggatcacatctgaggatctaaagaatgaagaaatgataacagaccaaatggaagggagacataagaagctggcagaggccatattcaaattaacataccagaacaaggtagttcgcgtccaaagaccaaccccaagaggcacggtgatggatatcatttcaaggagagaccaaagaggcagtgggcaggtggggacgtacggtctcaataccttcaccaatatggaagcacaactgataaggcagatggaaggggaaggactctttaagagcatactgcatttaacaccccaagaggaaacagctgtccacgcttggctagttagagagggacgcgaacgcctcgcaagaatggcaatcagtggagatgactgcgtcgtgaaaccactagatgacagattcgccagagctttaacagcattgaatgacatgggaaaagtgaggaaagacatacaacagtgggaaccctcaaaaggatggagtgattggacccaagtgcccttttgctctcaccactttcatgaattaataatgaaagatggtcgcaagcttgtagtcccatgcagaaaccaggatgaactgataggcagagcgcgtatctcccagggggcaggatggtccttgagagagacagcctgtttggggaagtcatatgcccagatgtggagcctgatgtacttccacaggcgtgatctcaggttggctgctaatgccatatgttcagcagttccatcacattgggttccaactagcaggacaacttggtctatacatgctagtcatgaatggatgacgacggaagacatgttagcagtctggaacagggtgtggatccaggacaatccatggatggaagacaagacccccgtggaatcatgggaagacataccatacttagggaaaagggaggaccagtggtgtggttccctgattggcttaacaagcagggccacctgggcaaagaacattcaaacagccataaaccaagtcagagctctcattggtgaggaggaatacacggactacatgccctcaatgaaaaggttcaggagtgaagaggaggagtcaggagtcctgtggtaa

SEQ ID NO: 734 - DNA, 10176 bp, Dengue virus
atgaataaccaacgaaaaaaggcgagaaatacgcctttcaatatgctgaaacgcgagagaaaccgcgtgtcaacaatacaacagttgacgaagagattctcacttggaacgctgcaggggagagggccattaaagctatttatggccctagtggcgttccttcgtttcctaaccatcccaccaacagcagggatactgaagagatggggaacgatcaaaaaatcaaaggctatcagtgtactgagaggatttagaaaggaaattgggaggatgctgaacattttgaacaggagacgcagaacagcgggcttcctcatcatggtcattccaacagtgatggctttccatttgaccacacgcaatggggagccacacatgattgtcagcaagaatgagaaaggaaagagcctcctttttaaaacagagaatggaataaacatgtgcacccttatggccatggatttaggcgagttgtgcgaggacaccgttacatacaagtgtccctttctcaagcaaaacgagccggaggacatagactgctggtgcaattccacatcaacctgggtgacgtacgggacgtgtagctcgacaggagagcataggagggagaaaaggtcagtcgcacttgtcccacacgtaggaatggggctggaaacgagaactgaaacatggatgtcatcagaaggagcatggaaacaagcccagcggattgagacatggattctgaggcacccaggtttcactcttatggcagctgttttggcgtacacaatagggacaacacatttccaaagagccctaatctttatccttttaactgccgttgctccctcaatgacaatgcgatgtataggcatatcgaaccgagactttgtagagggagtttcaggaggaagctgggttgatattgtcttagaacatgggagctgcgtcacaacaatggccaagaacaaaccaacattagactttgaactaataaaaacagaggccaagcaactagcaacattgagaaaattctgcattgaagccaaattgaccaacacaacaacagaatctcgctgcccaacccaaggtgaacccagcctagtagaggagcaggacaaaagattcgtttgcaggcattcgatggtggatagaggttggggtaatggatgtggtctgtttgggaaaggaggcattgtgacctgtgcgatgttcacatgcttgaagaaaatggagggaaaagttgtgcagccagaaaacctagagtacaccatagtcataacaccccattcaggagaggaacatgctgtggggaatgatacagggaagcacggcaaggaggttaaaataacaccccaaagctctattgctgaagctgaactaacagattatggcacgatcacgatggaatgctccccacgaacaggtctcgattttaacgagatggtcctgctgcagatggagagcaaagcttggctagtccatagacagtggtttctggacttacctctaccatggcttcctggagcagacacacaagggtccaattggatccagaaagagatgctagtaacattcaaaaatccccatgcgaaaagacaagacgttgtcgtcttgggatcgcaagagggcgccatgcacacagcactcacaggagcaacagaaattcaaatgtcattaggaaacatactatttatggggcatttgaagtgtagactgaggatggacaagctgcaactcaaagggatgtcgtactctatgtgcacaggaaagttcaaggttgtcaaagagatagcggaaacacaacatggaacaatagtcatcagagtgcagtatgaaggagatgactcaccatgcaagattccttttgagatcatggacttggaaaagaaacatgttttagggcgattgatcacggtcaacccaatagtgacagagaaagacaatccaatcaacatagaagcagaacctccatttggtgatagctacattgtcataggagtggagccaggacagctgaaattaaactggtttaaaaaaggaagctctataggacaaatgtttgaaacaacaatgagaggagctaaaagaatggccatcttgggagacacagcttgggactttggatccatagggggagtgttcacatcagtagggaaagcactacatcaagtttttggcgcaatctatggcgccgcctttagcggggtttcatggactatgaagattctcataggggtggttataacatggataggaatgaattcccgcagcacttccctgtcagtgaccctggtgttagtaggattcgtgacactatacctgggagtgatggtgcaagcggacagtggctgtgttgtaagctggaagaacaaagaactgaaatgtggaagtgggatctttgtaactgacaatgtgcacacttggacggaacaatacaaatttcaaccagactccccttcaaagctggcttccgcaattcaaaaagctcatgaggaaggaatctgtggaatccgttcagtgacaaggttggaaaatctgatgtggaagcagataacaccagaattgaaccacatcctatccgaaaatgaagtcaaactgaccatcatgacaggagagattaaggggattatgcaagcagggagaagatctttgaaaccccaacctactgagctgagatactcatggaaaacttggggaaaagcgaaggtactatcaacagaactccaaaatcaaactttcctcatagacggtcctgaaacaactgaatgccctaatagcaatagagcctggaactctttggaagttgaggattatggctttgggatttttaccactaacatatggctaaagttgagagagaaacaagacatgatttgtgattcaaagttgatgtcagcagctgttaaggacgacagagcagttcatgctgatatgggctattggatagagagcagactgaatgacacatggaagatggaaaaagcatcatttattgaggttaaaagctgctactggccaagatcacacaccctttggagcaacggagtgctggagagtgaaatgataattccaaagaatctggctggaccagtgtcgcagcacaactacagaccaggctatcatacgcaaacagccggaccatggcatttgggcaaactcgagatggatttcgagttttgtgaaggaaccacggtagtggtgaccgaggattgcggaaacagaggaccatccttgagaacaaccactgcctcaggaaaactcataactgagtggtgctgcagatcatgcacactaccaccactaagatatagaggagaggatggatgttggtacggaatggaaattagaccactgaaagaaagagaagagaacctggtgaactcattggttacagccggacatggccaaattgacaatttttcactagggattctgggaatggcattgctcttggaagagatgcttagaactagagtaggaacaaagcacgccctgctgctagtggcgatctccttcgtgtcactgattacagggaatatgtccttcaaggatttaggaagagtgataattatggtgggagcagccatgacggacgagatgggtatgggcgtgacatacttggcattactagctgctttcagagtcagacctacctttgcagtggggttgcttttgagaaaacttacttcaaaggaattgttgatggcaaccatcggagtcgttctcctctctcagagtaacataccaggaacagttttggaactaactgatgcaatagcattgggaataatggttcttaaaatagtgaggagtatggaaaaataccagctagcagtgaccgtcatggctatgctatgtattccaaatgtcatgatactccagcatgcatggaaagtgggctgtaccatattggcagcagtttctgtatcaccactcctcttgacttcctcacaacaaaaaacggactggataccgttagtcctcacaataaaaggtctcaatccgactgctatcttcttaacaactctgtctagacccaataaaacaagaagttggcctctcaatgaagctatcatggcagttggaatggtgagcatactagctagttcccttctgaaaaatgacattccaatgacgggaccactggtggcaggaggacttctcacagtgtgctatgtgcttactggcagatcggcagacttggagctagagaaagccgcagaggtgaaatgggaagatcaagctgagatatctgggagtagcccaatcctatcagtcactatatcagaagatggtagtatgtcaataaagaatgaggaagaagaacagaccttaactatactgataaggacgggactgttagtaatatcaggactattcccagtatcaatcccaatcacagccgcggcctggtacttatgggagacaaaaaagcagagggccggagtgctgtgggacgttccttcacctccaccaatggaaaaagctgagctagaagatggcgcttacagaatcaaacagagagggattctcggatactctcaaattggagctggagtgtataaagaaggtacatttcacacgatgtggcacgtcacacgtggagctgtcctagtgcacaaagggaaaagaattgagccatcatgggcagacgtgaagaaagacttgatatcatatggaggaggctggaaactggaaggagagtggaaagaaggcgaagaagttcaggttttggcgctggaacctggaaaaaacccgagagcagtgcaaacaaaacccggcctcttcaaaaccaatacaggaacaataggagccgtatccttagacttctccccaggaacatcaggatccccaatcattgacaagaaaggaaaggtcgtgggtctctacggaaatggcgtcgtgacaagaagcggaacctatgtgagctccatagcccaaacagagaaaagcgtggaggacaatccagagattgaagatgatatatttcggaagaaaaggctaaccatcatggacttacatccaggagcgggaaaaacaaagcgatacctcccagccatagttagagaagcaataagaagaggcctgagaacactgattctggcccccaccagagtagtggctgcagaaatggaggaagccctacgggggctcccaatccgttatcagactccagccatcaaggcagagcacacagggcgcgaaatcgtagacctaatgtgtcatgccacattcaccatgaggttactgtcaccaattagggtaccaaactacaacttaatcataatggatgaagctcatttcacagacccagctagcatagcagctcgaggatacatctccacccgagtagaaatgggagaagctgctggaatatttatgacagccactcctccaggcagcagggacccttttccacagagcaacgccccaatagtggacgaggaaagagagattcccgaacgctcatggaattccggacatgaatggataacaaactttaaaggcaaaacagtatggtttgtcccgagcataagagctggaaacgacatagcagcctgcttaaggaaaaatgggaaaagagtgattcagctaagtaggaaaacctttgacacagaatacatcaaaacaagaacaaatgactgggacttcgtagtcacgactgacatctcagaaatgggggcaaacttcaaagctgaaagagtgatagatccaaggagatgtatgaagccagttatactgacagatggtgaagagcgtgtggttctggcaggacccatgccagtcactcactcaagtgcagcacagagaagagggagaataggaaggaatccaaaaaatgagaatgaccaatatatctacatgggagaacctttagagaatgatgaagactgtgctcactggaaggaggcaaagatgctccttgataacatcaacacacctgaaggtatcatccccagcatgttcgagccagaacgtgagaaagttgatgccatagacggtgaataccggctaaggggggaagcaaggaagacttttgtggatctgatgaaaagaggagacctaccagtttggctggcttacaaagtagcctcggaaggcataagctatgcagacaggaagtggtgctttgatggaatcagaaataatcagatcctggaggagaacatggaagtggaagtttggacgaaagaaggtgagaggaaaaaactaaaacccagatggttggatgcaagaacttactcagatccgctagcacttaaagagttcaaggaatttgcggccggaaggaagtctctaactctgagtttgatcacagaaatgggtcggctcccaaccttcatgacccaaaagacaagagatgccctggacaacttggctgtactgcactctgcagaaatgggtggaagagcctataaccatgctctcagtgaattgccagaaactttagaaacattactcctgctaggtctcctggccacagtcacagggggaatctttttgttcttgatgagtggaagaggtgtagggaaaatgaccctcggaatgtgttgcataatcacggccagcggccttctgtggtatgcacagatacagccccattggattgcagcctcaataatactagagttctttctcatagtactgctaatccctgaaccagagaagcaaagaacaccccaggacaaccagttgacctatgtggtcatagccatcctgacattagtggcagccaccatggcaaacgaaatgggttttctagaaaagacaaagaaagaccttgggttgggaggtattacaatgcaacaaccagaaataaatatcttggacatagacctccgacctgcatcagcgtggacactatatgcagtggctactacgtttgtcacgccaatgctgaggcacagcatagaaaactcctcagtgaatgtgtcactaacagctatagcaaatcaggccacggtgcttatgggcttgggaaaaggttggccactatcaaaaatggacataggagttcctcttcttgccattggatgctactcgcaggtgaatcccataaccctcacagcagcactactgctgttaatggcacactatgccatcataggccctggactccaagcaaaggctaccagagaggcgcagaaaagagcagcagccggcatcatgaagaatccaacagtagatgggattacagtgattgacctagaaccaataccctatgatccgaagtttgagaagcagttagggcaagtgatgctcttggtcctttgtgtgacacaggtgctgatgatgagaaccacgtgggctctatgcgaagccctaaccctagcaacagggcccatatcaacactgtgggaaggaaatccagggaaattctggaacacaacaatagcagtctctatggccaacattttcagagggagttatttggctggagctggactccttttttccatcatgaggaacacaaccagcgcacgaagaggaaccggcaccataggtgaaactttaggagaaaaatggaagagtcggctaaatgcactgggaagaagtgaattccagatatacaagaaaagtgggattcaggaggtagacagaaccctggcgaaggaaggcataaaaagaggagaaacagaccaccatgccgtttcacggggctctgcaaagctgagatggtttgttgaaagaaacatggtcgccccagaaggaaaggtagtagaccttggttgtggcagaggaggatggtcatattactgtggtggactaaaaaatgtgagagaagtcaaaggcctgacaaaaggaggaccaggacatgaggagcctatacctatgtcaacatacgggtggaatctagtgcgactgcagagtggagtggatgtattctttactccaccagagagatgcgacacactgctatgcgacataggagaatcgtcaccaaaccccacagtggaggccggacgaacactgagagttctcaatctagtagaaaattggctggggagcaacacacagttttgcgtaaaagtcctcaacccttacatgccatcagtcatagagagaatggaagcactacagagaaagtttggaggcgctctagttcgcaatccactctcaaggaattccacgcatgagatgtactgggtgtccaacgcttctggaaatattgtgtcttctgtgaacatgatttcaaggatgttgataaatagattcacaatgaggcacaagagagctacctacgagcctgatgttgatcttggaagtggaacacgcaacattggaattgagtgtgagacgccaaatatggacataattggaaaacggattgagaaaataaaacaagaacatgaaacgtcatggcactatgaccaagatcatccatacaaaacatgggcataccacggcagttatgagacgaaacaaacaggatcagcatcatcaatggtaaacggagtggtcaggctgttgaccaaaccctgggatgtcatccccatggtgacgcaaatggcaatgacagacacaaccccctttggacagcagcgtgttttcaaggaaaaagtagacacaagaacccaggaaccaaaagaaggcacgaaaaaattgatgagaatcacagcaaagtggctttggggtgagttaggaagaagaaagaagcccagaatctgcacaagagcagagttttgcaacaaagtgagaagcaacgcagctctgggggctgtgttcactgatgagaacaagtggaagtcagcacgcgaagcggtcgaagatgaaagattttgggaactggtggaaaaagagagaaaccttcaccttgacggaaagtgtgaaacatgtgtgtacaacatgatgggaaaaagagagaagaaactgggagaattcggcaaagcaaaaggcagcagagccatatggtacatgtggctaggtgcccgctttttggagtttgaggccctaggttttttgaacgaagaccattggttctctagagaaaactctctaagtggagtggaaggagaaggactgcacaagctgggctacatcctaagagacattagcagaaaagcaggaggagcaatgtacgcagatgacactgctggttgggacacaaggatcacatctgaggatctaaagaatgaagaaatgataacagaccaaatggaagggagacataagaagctggcagaggccatattcaaattaacataccagaacaaggtagttcgcgtccaaagaccaaccccaagaggcacggtgatggatatcatttcaaggagagaccaaagaggcagtgggcaggtggggacgtacggtctcaataccttcaccaatatggaagcacaactgataaggcagatggaaggggaaggactctttaagagcatactgcatttaacaccccaagaggaaacagctgtccacgcttggctagttagagagggacgcgaacgcctcgcaagaatggcaatcagtggagatgactgcgtcgtgaaaccactagatgacagattcgccagagctttaacagcattgaatgacatgggaaaagtgaggaaagacatacaacagtgggaaccctcaaaaggatggagtgattggacccaagtgcccttttgctctcaccactttcatgaattaataatgaaagatggtcgcaagcttgtagtcccatgcagaaaccaggatgaactgataggcagagcgcgtatctcccagggggcaggatggtccttgagagagacagcctgtttggggaagtcatatgcccagatgtggagcctgatgtacttccacaggcgtgatctcaggttggctgctaatgccatatgttcagcagttccatcacattgggttccaactagcaggacaacttggtctatacatgctagtcatgaatggatgacgacggaagacatgttagcagtctggaacagggtgtggatccaggacaatccatggatggaagacaagacccccgtggaatcatgggaagacataccatacttagggaaaagggaggaccagtggtgtggttccctgattggcttaacaagcagggccacctgggcaaagaacattcaaacagccataaaccaagtcagagctctcattggtgaggaggaatacacggactacatgccctcaatgaaaaggttcaggagtgaagaggaggagtcaggagtcctgtggtaa

SEQ ID NO: 735 - DNA, 10176 bp, Dengue virus
atgaataaccaacggaaaaaggcgagaaatacgcctttcaatatgctgaaacgcgagagaaaccgcgtgtcaacaatacaacagttgacgaagagattctcacttggaatgctgcaggggagagggccattaaagctatttatggccctagtggcgttccttcgtttcctaaccattccaccaacagcagggatactgaagagatggggaacgatcaaaaaatcaaaggctatcagtgtactgagaggatttagaaaggaaattgggaggatgctgaacattttgaacaggagacgcagaacagcgggcttcctcatcatggtcattccaacagtgatggctttccatttgaccacacgcaatggggagccacacatgattgtcagcaagaatgagaaaggaaagagcctcctttttaaaacagagaatggaataaacatgtgcacccttatggccatggatttaggcgagttgtgcgaggacaccgttacatacaagtgtccctttctcaagcaaaacgagccggaggacatagactgctggtgcaattccacatcaacctgggtgacgtacgggacgtgtagctcgacaggagagcataggagggagaaaaggtcagtcgcacttgtcccacacgtaggaatggggctggaaacgagaactgaaacatggatgtcatcagaaggagcatggaaacaagcccagcggattgagacatggattctgaggcacccaggtttcactcttatggcagctgttttggcgtacacaatagggacaacacatttccaaagagccctaatctttatccttttaactgccgttgctccctcaatgacaatgcgatgtataggcatatcgaaccgagactttgtagagggagtttcaggaggaagctgggttgatattgtcttagaacatgggagctgcgtcacaacaatggccaagaacaaaccaacattagactttgaactaataaaaacagaggccaagcaactagcaacattgagaaaattctgcattgaagccaaattgaccaacacaacaacagaatctcgctgcccaacccaaggtgaacccagcctagtagaggagcaggacaaaagattcgtttgcaggcattcgatggtggatagaggttggggtaatggatgtggtctgtttgggaaaggaggcattgtgacctgtgcgatgttcacatgcttgaagaaaatggagggaaaagttgtgcagccagaaaacctagagtacaccatagtcataacaccccattcaggagaggaacatgctgtggggaatgatacagggaagcacggcaaggaggttaaaataacaccccaaagctctattgctgaagctgaactaacagattatggcacgatcacgatggaatgctccccacgaacaggtctcgattttaacgagatggtcctgctgcagatggagagcaaagtttggctagtccatagacagtggtttctggacttacctctaccatggcttcctggagcagacacacaagggttcaattggatccagaaagagatgctagtaacattcaaaaatccccatgcgaaaagacaagacgttgtcgtcttgggatcgcaagagggcgccatgcacacagcactcacaggagcaacagaaattcaaacgtcattaggaaacatactatttatggggcatttgaagtgtagactgaggatggacaagctgcaactcaaagggatgtcgtactctatgtgcacaggaaagttcaaagttgtcaaagagatagcggaaacacaacatggaacaatagtcatcagagtgcagtatgaaggagatgactcaccatgcaagattccttttgagatcatggacttggaaaagaaacatgttttagggcgattgatcacggtcaacccaatagtgacagagaaagacaatccaatcaacatagaagcagaacctccatttggtgatagctacattgtcataggagtggagccaggacagctgaaattaaactggtttaaaaaaggaagctctataggacaaatgtttgaaacaacaatgagaggagctaaaagaatggccatcttgggagacacagcttgggactttggatccatagggggagtgttcacatcagtagggaaagcactacatcaagtttttggcgcaatctatggcgccgcctttagcggggtttcatggactatgaagattctcataggggtggttataacatggataggaatgaattcccgcagcacttccctgtcagtgaccctggtgttagtaggaatcgtgacactatacctgggagtgatggtgcaagcggacagtggttgtgttgtaagctggaagaacaaagaactgaaatgtggaagtgggatctttgtaactgacaatgtgcacacttggacggaacaatacaaatttcaaccagactccccttcaaagctggcttccgcaattcaaaaagctcatgaggaaggaatctgtggaatccgttcagtgacaaggttggaaaatctgatgtggaagcagataacaccagaattgaaccacatcctatccgaaaatgaagtcaaactgaccatcatgacaggagagattaaggggattatgcaagcagggagaagatctttgaaaccccaacctactgagctgagatactcatggaaaacttggggaaaggcgaaggtactatcaacagaactccaaaatcaaactttcctcatagacggtcctgaaacaactgaatgccctaatagcaatagagcctggaactctttggaagttgaggattatggctttgggatttttaccactaacatatggctaaagttgagagagaaacaagacatgatttgtgattcaaagttgatgtcagcagctgttaaggacgacagagcagttcatgctgatatgggctattggatagagagcagactgaatgacacatggaagatggaaaaagcatcatttattgaggttaaaagctgctactggccaagatcacacaccctttggagcaacggagtgctggagagtgaaatgataattccaaagaatctggctggaccagtgtcgcagcataactacagaccaggctattatacgcaaacagccggaccatggcatttgggcaaactcgagatggatttcgagttttgtgaaggaaccacggtagtggtgaccgaggattgcggaaacagaggaccatccttgagaacaaccactgcctcaggaaaactcataactgagtggtgctgcagatcatgcacactaccaccactaagatatagaggagaggatggatgttggtacggaatggaaattagaccactgaaagaaagagaagagaacctggtgaactcattggttacagccggacatggccaaattgacaatttttcactagggattctgggaatggcattgctcttggaagagatgcttagaaccagagtaggaacaaagcacgccttgctgctagtggcgatctccttcgtgacactgattacagggaatatgtccttcaaggatctaggaagagtgataattatggtgggagcagccatgacggacgagatgggtatgggcgtgacatacttggcattactagctgctttcagagtcagacctacctttgcagtggggttgcttttgagaaaacttacttcaaaggaattgttgatggcaaccatcggagtcgttctcctctctcagagtaacataccaggaacagttttggaactaactgatgcaatagcattgggaataatggttcttaaaatagtgaggagtatggaaaaataccagctagcagtgaccgtcatggctatgctatgtattccaaatgtcatgatactccagcatgcatggaaagtgggctgtaccatattggcagcagtttctgtatcaccactcctcttgacttcctcacaacaaaaaacggactggataccgttagtcctcacaataaaaggtctcaatccgactgctatcttcttaacaactctgtctagacccaataaaacaagaagttggcctctcaatgaagctatcatggcagttggaatggtgagcatactagctagttcccttctgaaaaatgacattccaatgacgggaccactggtggcaggaggacttcttacagtgtgctatgtgcttactggcagatcggcagacttggagctagagaaagccgcagaggtgaaatgggaagatcaagctgagatatctgggagtagcccaatcctatcagtcaccatatcagaagatggtagtatgtcaataaagaatgaggaagaagaacagaccttaactatactgataaggacgggactgttagtaatatcaggactattcccagtatcaatcccaatcacagccgcggcctggtacttatgggagacaaaaaagcagagggccggagtgctgtgggacgttccttcacctccaccaatggaaaaagctgagctagaagatggcgcttacagaatcaaacagagagggattctcggatactctcaaattggagctggagtgtataaagaaggtacatttcacacgatgtggcacgtcacacgtggagctgtcctagtgcacaaagggaaaagaattgagccatcatgggcagacgtgaagaaagacttgatatcatatggaggaggctggaaactggaaggagagtggaaagaaggcgaagaagttcaggttttggcgctggaacctggaaaaaacccgagagcagtgcaaacaaaacccggcctcttcaaaaccaatacaggaacaataggagccgtatccttagacttctccccaggaacatcaggatccccaatcattgacaagaaaggaaaggtcgtgggtctctacggaaatggcgtcgtgacaagaagcggaacctatgtgagctccatagcccaaacagagaaaagcgtggaggacaatccagagattgaagatgatatatttcggaagaaaaggctaaccatcatggacttacatccaggagcgggaaaaacaaagcgatacctcccagccatagttagagaagcaataagaagaggcctgagaacactgattctggcccccaccagagtagtggctgcagaaatggaggaagccctacgggggctcccaatccgttatcagactccagccatcaaggcagagcacacagggcgcgaaatcgtagacctaatgtgtcatgccacattcaccatgaggttactgtcaccaattagggtaccaaactacaacttaatcataatggatgaagctcatttcacagacccagctagcatagcagctcgaggatacatctccacccgagtagaaatgggagaagctgctggaatatttatgacagccactcctccaggcagcagggacccttttccacagagcaacgccccaatagtggacgaggaaagagagattcccgaacgctcatggaattccggacatgaatggataacaaactttaaaggcaaaacagtatggtttgtcccgagcataagagctggaaacgacatagcagcctgcttaaggaaaaatgggaaaagagtgattcagctaagtaggaaaacctttgacacagaatacatcaaaacaagaacaaatgactgggacttcgtagtcacgactgacatctcagaaatgggggcaaacttcaaagctgaaagagtgatagatccaaggagatgtatgaagccagttatactgacagatggtgaagagcgtgtggttctggcaggacccatgccagtcactcactcaagtgcagcacagagaagagggagaataggaaggaatccaaaaaatgagaatgaccaatatatctacatgggagaacctttagagaatgatgaagactgtgctcactggaaggaggcaaagatgctccttgataacatcaacacacctgaaggtatcatccccagcatgttcgagccagaacgtgagaaagttgatgccatagacggtgaataccggctaaggggggaagcaaggaagacttttgtggacctgatgaaaagaggagacctaccagtttggctggcttacaaagtagcctcggaaggcataagctatgcagacaggaagtggtgctttgatggaatcagaaataatcagatcctggaggagaacatggaagtggaagtttggacgaaagaaggtgagaggaaaaaactaaagcccagatggttggatgcaagaacttactcagatccgctagcacttaaagagttcaaggaatttgcggccggaaggaagtctctaactctgagtttgatcacagaaatgggtcggctcccaaccttcatgacccaaaagacaagagatgccctggacaacttggctgtactgcactctgcagaaatgggtggaagagcctataaccatgctctcagtgaattgccagaaactttagaaacattactcctgctaggtctcctggccacagtcacagggggaatctttttgttcttgatgagtggaagaggtgtagggaaaatgaccctcggaatgtgttgcataatcacggccagcggccttctgtggtatgcacagatacagccccactggattgcagcctcaataatactagagttctttctcatagtactgctaatccctgaaccagagaagcaaagaacaccccaggacaaccagttgacctatgtggtcatagccatcctgacattagtggcagccaccatggcaaacgaaatgggttttctagaaaagacaaagaaagaccttgggttgggaggtattacaacgcaacaaccagaaataaatatcttggacatagacctccgacctgcatcagcgtggacactatatgcagtggctactacgtttgtcacgccaatgctgaggcacagcatagaaaactcctcagtgaatgtgtcactaacagctatagcaaatcaggccacggtgcttatgggcttgggaaaaggttggccactatcaaaaatggacataggagttcctcttcttgccattggatgctactcgcaggtgaatcccataaccctcacagcagcactactgctgttagtggcacactatgccatcataggccctggactccaagcaaaggctaccagagaggcgcagaaaagagcagcagccggcatcatgaagaatccaacagtagatgggattacagtgattgacctagaaccaataccctatgatccgaagtttgagaagcagttagggcaagtgatgctcttggtcctttgtgtgacacaggtgctgatgatgagaaccacgtgggctctatgcgaagccctaaccctagcaacagggcccatatcaacactgtgggaaggaaatccagggaaattctggaacacaacaatagcagtctctatggccaacattttcagagggagttatttggctggagctggactccttttttccatcatgaggaacacaaccagcgcacgaagaggaaccggcaccataggtgaaactttaggagaaaaatggaagagtcggctaaatgcactgggaagaagtgaattccagatatacaagaaaagtgggattcaggaggtagacagaaccctggcgaaggaaggcataaagagaggagaaacagaccaccatgccgtttcacggggctctgcaaagctgagatggtttgttgaaagaaacatggtcgccccagaaggaaaggtagtagaccttggttgtggcagaggaggatggtcatattactgtggtggactaaaaaatgtgagagaagtcaaaggcctgacgaaaggaggaccaggacatgaggagcctatacctatgtcaacatacgggtggaatctagtgcgactgcagagtggagtggatgtattcttcactccaccagagagatgcgacacactgctatgcgacataggagaatcgtcaccaaaccccacagtggaggccggacgaacactgagagttctcaatctagtagaaaattggctggggagcaacacacagttttgcgtaaaagtcctcaacccttacatgccatcagtcatagagagaatggaagcactacagagaaagtttggaggcgctctagttcgcaatccactctcaaggaattccacgcatgagatgtactgggtgtccaacgcttctggaaatattgtgtcttctgtgaacatgatttcaaggatgttgataaatagattcacaatgaggcacaagaaagtcacctacgagcctgatgttgatcttggaagtggaacacgcaacattggaattgagtgtgagacgccaaatatggacataattggaaaacggattgagaaaataaaacaagaacatgaaacgtcatggcactatgatcaagatcatccatacaaaacatgggcataccacggcagttatgagacgaaacaaacaggatcagcatcatcaatggtaaacggagtggtcaggctgttgaccaaaccctgggatgtcattcccatggtgacgcaaatggcaatgacagacacaaccccctttggacagcagcgtgttttcaaggaaaaagtagacacaagaacccaggaaccaaaagaaggcacgaaaaaattgatgagaatcacagcaaagtggctttggggtgagttaggaagaagaaagaagcccagaatctgcacaagagcagagttctgcaacaaagtgagaagcaacgcagctctgggggctgtgttcactgatgagaacaagtggaagtcagcacgcgaagcggtcgaagatgaaagattttgggaactggtggaaaaagagagaaaccttcaccttgacggaaagtgtgaaacatgtgtgtacaacatgatgggaaaaagagagaagaaactgggagaattcggcaaagcaaaaggcagcagagccatatggtacatgtggctaggtgcccgctttttggagtttgaggccctaggttttttgaacgaagaccattggttctctagagaaaactctctaagtggagtggaaggagaaggactgcacaagctgggctacatcctaagagacattagcagaaaagcaggaggagcaatgtacgcagatgacactgctggttgggacacaaggatcacatctgaggatctaaagaatgaagaaatgataacagaccaaatggaagggagacataagaagctggcagaggccatattcaaattaacataccagaacaaggtagttcgcgtccaaagaccaaccccaagaggcacggtgatggatatcatttcaaggagagaccaaagaggcagtgggcaggtggggacgtacggtctcaataccttcaccaatatggaagcacaactgataaggcagatggaaggggaaggactctttaagagcatactgcatttaacaccccaagaggaaacagctgtccacgcttggctagttagagagggacgtgaacgcctcgcaagaatggcaatcagtggagatgactgcgtcgtgaaaccactagatgacagattcgccagagctttaacagcattgaatgacatgggaaaagtgaggaaagacatacaacagtgggaaccctcaaaaggatggagtgattggacccaagtgcccttttgctctcaccactttcatgaattaataatgaaagatggtcgcaagcttgtagtcccatgcagaaaccaggatgaactgataggcagagcgcgtatctcccagggggcaggatggtccttgagagagacagcctgtttggggaagtcatatgcccagatgtggagcctgatgtacttccacaggcgtgatctcaggttggctgctaatgccatatgttcagcagttccatcacattgggttccaactagcaggacaacttggtccatacatgctagtcatgaatggatgacgacggaagacatgttagcagtctggaacagggtgtggatccaggacaatccatggatggaagacaagacccccgtggaatcatgggaagacataccatacttagggaaaagggaggaccagtggtgtggttccctgattggcttaacaagcagggccacctgggcaaagaacattcaaacagccataaaccaagtcagagctctcattggtgaggaggaatacacggactacatgccctcaatgaaaaggttcaggagtgaagaggaggagtcaggagtcctgtggtaa

SEQ ID NO: 736 - DNA, 10176 bp, Dengue virus
atgaataaccaacggaaaaaggcgagaaatacgcctttcaatatgctgaaacgcgagagaaaccgcgtgtcaactgtgcagcagctgacaaagagattctcacttggaatgctacagggacgaggaccattgaaactgttcatggccctggtggcattccttcgtttcctaacaatcccgccaacagcagggatattaaaaagatggggaacaatcaaaaaatcaaaggctatcaatgtcttgagagggttcaggaaagagatcggaaggatgctgaacatcttgaacaggagacgcagaactgcaggtataattattatggtgattccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttacaattgtcctcttctcaggcagaatgaaccagaagacatagactgttggtgcaactctacgtctacatgggtaacttatgggacatgcaccgctacaggagaacacagaagggaaaaaagatcagtggcactcgttccacatgtgggaatgggactggagacacgaactgaaacatggatgtcatcagaaggggcctggaaacatgcacagagaattgaaacttgggtcttgagacatccaggcttcaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttggaacatggaagctgtgtgacgacgatggcgaaaaacaaaccaacattggattttgaactgataaagacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggagggaaaaatcgtgcaaccagaaaacttggagtacaccattgtgataacacctcactcaggggaagagaatgcagtcggaaatgacacaggaaaacacggcaaggaaattaaagtaacaccacagagttccatcacagatgcagaactaacaggctatggcactgtcacgatggaatgctctccgagaacgggactcgacttcaatgagatggtgttgctgcaaatggaaaacaaggcttggctggtgcacaggcaatggttcttagacctgccattaccatggctgcccggagcagacacacaaggatcaaattggatacagaaggagacattggtcactttcaaaaatccccatgcaaagaaacaggatgttgttgttttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgtcacagaaaaagacagcccagtcaacatagaagcagaacccccattcggagacagctatatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggagtcgtgacattgtatttgggagttatggtgcaggccgatagtggttgcgttgtgagctggaaaaacaaagaactgaaatgtggcagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaactgaatcacattctatcagaaaatgaggtgaagttgactatcatgacaggagatattaaaggaatcatgcaggcaggaaaacgatccctgcggcctcaacccactgagctgaagtactcttggaaagcatggggcaaagcgaaaatgctccccacagagcttcataaccacacctttctcattgatggccccgaaacagcagaatgtcccaacacaaacagagcttggaactcactagaggttgaagactatggctttggagtattcaccaccaacatatggctgaaattgaaagaaaggcaggatgtattttgtgactcaaaactcatgtcagcagccataaaagacaacagagccgtccacgccgacatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaaccacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaggagaaagaagagaacttggtcaactctttggtcacagccggacatggacagattgacaacttctcactaggagtcttgggaatggcattgttcctggaagagatgctcagaacccgagtaggaacgaaacatgcaatattactagttgcagtctctttcgtgacattgatcacagggaacatgtcctttcgagatttggggagagtgatggtcatggtgggcgctactatgacggatgacataggcatgggtgtgacttatcttgccctattagcagccttcaaggttagaccaacttttgcagctggactactcttaagaaagctgacctccaaggaattgatgatgaccaccataggaatcgtactcctctctcagagcaccataccagaaactatacttgaactgactgacgcattggctttggggatgatggttctcaaaatagtaagaaacatggaaaagtatcaactagcagtgactatcatggctatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattggtggctggagggcttctcactgtgtgttacgtgctcactggaagatcggctgatttggaactggagagagctgctgacgtaagatgggaagaacaggcagagatatcaggaagcagtccatttctgtcgataacaatatcggaagatggtagcatgtcgataaaaaatgaagaagaagaacaaacactgaccatactgattagaacaggactgctggtgatatcaggactttttcccgtgtcaataccaatcacggcagctgcatggtacctgtgggaagtgaaaaaacaacgagccggagtattgtgggatgtcccttcacctccacctgtgggaaaggccgaactggaagatggagcctatagaatcaagcagaaagggattctaggatactcgcagatcggagccggagtctacaaagaaggaacattccacacaatgtggcatgtcacacgtggtgctgttctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaatcataggcgccgtatctctggacttttctcctggaacgtcaggatctccaattgtcgacaaaaaaggaaaagttgtgggcctttatggcaacggtgtcgtcacaaggagtggaacatatgtgagtgccatagcccagactgaaaaaagcattgaagacaacccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccatttcctcagagcaatgcaccaatcatggatgatgaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatacatcaagactaggaccaatgattgggactttgtggtcacgacagacatttcagaaatgggtgctaacttcaaggctgagagggttatagaccccagacgctgcatgaaaccagtcatactaacagacggtgaagagcgggtgattctggcaggacccatgccagtgacccactctagtgcagcacaaagaagagggagaataggaagaaatccaaaaaatgaaaatgaccagtacatatacatgggggaacctctggaaaatgatgaagactgcgcacactggaaagaagctaagatgcttctagataacatcaacacgcctgaaggaatcattcccagcatgttcgaaccagagcgtgaaaaggtcgacgccattgatggtgaataccgcttgagaggagaagcgaggaaaacatttgtggacctaatgagaagaggagacctaccagtctggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttagatgctaggatctactctgacccactggcgctcaaagaattcaaggaattcgcagctggaagaaaatccctgaccttgaatctaatcaccgagatgggtaggctcccaaccttcatgacccagaaagcaaggaatgcattggacaacttagcagtcctgcatacggctgaagcaggcggaagggcgtacaaccatgctcttagtgaactgccggagactctggagacattgcttttactgacacttttggccacagtcacgggcggaatcttcctgttcttgatgagcggaaagggtatagggaagatgactctgggaatgtgctgcataatcacggccagtactctcctatggtatgcacaaatacagccacattggatagcagcttcaataatactggagttttttctcatagtcttgctcattccagaaccagaaaagcagagaacaccccaagacaaccaattaacttatgttgtcatagccatccttacagtggtggccgcaaccatggcaaacgagatgggtttcctggaaaaaacaaagaaagatttcggattgggaagtattacaacccagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcgaaaatggacatcggagttccccttctcgctatcggatgctattcacaagtcaaccccataactctcacagcagcccttctcttattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcgaccgggcccatctctacactgtgggaaggaaatccagggagattttggaatacaactattgcagtgtcaatggctaacatttttagagggagttacctggccggagccggacttctcttttctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaagagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagtcgatgtcttttttactccgccagaaaagtgtgacacattgctgtgtgacataggggagtcgtcaccaaaccccacggttgatgcaggacgaacactcagagttctaaacttagtggacaactggctgaacaacaacacccaattttgcataaaggttctcaacccatatatgccttcagttatagaaaaaatggaagcgctacaaaggaaatatggaggagctttggtgaggaatccactctcacgaaattccacacaccagatgtactgggtatccaatgcttccgggaacatagtgtcatcagtgaacatgatttcaagaatgttgattaacagattcacaatgagacacaagaaggccacatacgagccagatgttgatctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctatcatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttgaaaaatgaagaaatggtgacaaaccacatggaaggagaacacaagaaacttgccgaagccattttcagattaacgtaccaaaacaaagtggtgcgtgtgcaaagaccgacaccaagaggcacagtaatggacattatatcgagaagagaccaaagaggtagtggacaggttgtcacctacggcctcaatactttcaccaacatggaagcccaactgatcagacagatggagggagaaggagtcttcaagagcatccagcacctgacagtcacagaagaaattgcagtgaaaaactggttagcaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtacttgtagttccatgtagaaaccaagatgaactgattggtagggcccgaatttcccagggagccgggtggtccctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 737 - DNA, 10176 bp, Dengue virus
atgaataaccaacggaaaaaggcgagaaatacgcctttcaatatgctgaaacgcgagagaaaccgcgtgtcaactgtgcagcagctgacaaagagattctcacttggaatgctacagggacgaggaccattgaaactgttcatggccctggtggcattccttcgtttcctaacaatcccgccaacagcagggatattaaaaagatggggaacaatcaaaaaatcaaaggctatcaatgtcttgagagggttcaggaaagagatcggaaggatgctgaacatcttgaacaggagacgcagaactgcaggtataattattatggtgattccaacagtgatggcgttccatttaaccacacgcaacggagaaccacacatgatcgtcagtagacaagagaaagggaaaagtcttctgtttaaaacagagaacggtgtgaacatgtgtacccttatggccatggaccttggtgaactgtgtgaagacacaatcacttacaattgtcctcttctcaggcagaatgaaccagaagacatagactgttggtgcaactctacgtctacatgggtaacttatgggacatgcaccgctacaggagaacacagaagggaaaaaagatcagtggcactcgttccacatgtgggaatgggactggagacacgaactgaaacatggatgtcatcagaaggggcctggaaacatgcacagagaattgaaacttgggtcttgagacatccaggcttcaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttggaacatggaagctgtgtgacgacgatggcgaaaaacaaaccaacattggattttgaactgataaagacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggagggaaaaatcgtgcaaccagaaaacttggagtacaccattgtgataacacctcactcaggggaagagaatgcagtcggaaatgacacaggaaaacacggcaaggaaattaaagtaacaccacagagttccatcacagatgcagaactaacaggctatggcactgtcacgatggaatgctctccgagaacgggactcgacttcaatgagatggtgttgctgcaaatggaaaacaaggcttggctggtgcacaggcaatggttcttagacctgccattaccatggctgcccggagcagacacacaaggatcaaattggatacagaaggagacattggtcactttcaaaaatccccatgcaaagaaacaggatgttgttgttttaggatcccaagaaggggctatgcacacagcactcacaggggccacggaaatccagatgtcatcaggaaacttactgttcacaggacatcttaaatgtaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgtcacagaaaaagacagcccagtcaacatagaagcagaacccccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggagtcgtgacattgtatttgggagttatggtgcaggccgatagtggttgcgttgtgagctggaaaaacaaagaactgaaatgtggcagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaactgaatcacattctatcagaaaatgaggtgaagttgactatcatgacaggagatattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcactagaggttgaagactatggctttggagtattcaccaccaacatatggctgaaattgaaagaaaggcaggatgtattttgtgactcaaaactcatgtcagcagccataaaagacaacagagccgtccacgccgacatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaaccacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaggagaaagaagagaacttggtcaactctttggtcacagccggacatggacagattgacaacttctcactaggagtcttgggatggcatttgttcctggaagagatgctcagaacccgagtaggaacgaaacatgcaatattactagttgcagtctctttcgtgacattgatcacagggaacatgtcctttcgagatttggggagagtgatggtcatggtgggcgctactatgacggatgacataggcatgggtgtgacttatcttgccctattagcagccttcaaggttagaccaacttttgcagctggactactcttaagaaagctgacctccaaggaattgatgatgaccaccataggaatcgtactcctctctcagagcaccataccagagactatacttgaactgactgacgcattggctttggggatgatggttctcaaaatagtaagaaacatggaaaagtatcaactagcagtgactatcatggctatcttgtgcgtcccaaatgcagtgatattacaaaacgcatggaaagtgagctgcacaacactggcagtggtgtccgtttccccactgcttttaacatcctcacagcagaaagcggattggataccactggcgctgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattggtggctggagggcttctcactgtgtgttacgtgctcactggaagatcggctgatttggaactggagagagctgctgacgtaagatgggaagaacaggcagagatatcaggaagcagtccatttctgtcgataacaatatcggaagatggtagcatgtcgataaaaaatgaagaagaagaacaaacactgaccatactgattagaacaggactgctggtgatatcaggactttttcccgtgtcaataccaatcacggcagctgcatggtacctgtgggaagtgaaaaaacaacgagccggagtattgtgggatgtcccttcacctccacctgtgggaaaggccgaactggaagatggagcctatagaatcaagcagaaagggattctaggatactcgcagatcggagccggagtctacaaagaaggaacattccacacaatgtggcatgtcacacgtggtgctgttctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaatcataggcgccgtatctctggacttttctcctggaacgtcaggatctccaattgtcgacaaaaaaggaaaagttgtgggcctttatggcaacggtgtcgtcacaaggagtggaacatatgtgagtgccatagcccagactgaaaaaagcattgaagacaacccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattataacctgattatcatggatgaagcccatttcacagacccagcaagcatagcagctagaggatacatttcaactcgagtagagatgggtgaagcagctgggattttcatgacagctacccctcctggaagcagagacccatttcctcagagcaatgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatacatcaagactaggaccaatgattgggactttgtggtcacgacagacatttcagaaatgggtgctaacttcaaggctgagagggttatagaccccagacgctgcatgaaaccagtcatactaacagacggtgaagagcgggtgattctggcaggacccatgccagtgacccactctagtgcagcacaaagaagagggagaataggaagaaatccaaaaaatgaaaatgaccagtacatatacatgggggaacctctggaaaatgatgaagactgcgcacactggaaagaagctaagatgcttctagataacatcaacacgcctgaaggaatcattcccagcatgttcgaaccagagcgtgaaaaggtcgacgccattgatggtgaataccgcttgagaggagaagcgaggaaaacatttgtggacctaatgagaagaggagacctaccagtctggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttagatgctaggatctactctgacccactggcgctcaaagaattcaaggaattcgcagctggaagaaaatccctgaccttgaatctaatcaccgagatgggtaggctcccaaccttcatgacccagaaagcaaggaatgcattggacaacttagcagtcctgcatacggctgaagcaggcggaagggcgtacaaccatgctcttagtgaactgccggagactctggagacattgcttttactgacacttttggccacagtcacgggcggaatcttcctgttcttgatgagcggaaaaggtatagggaagatgactctgggaatgtgctgcataatcacggccagtactctcctatggtatgcacaaatacagccacattggatagcagcttcaataatactggagttttttctcatagtcttgctcattccagaaccagaaaagcagagaacaccccaagacaaccaattaacttatgttgtcatagccatccttacagtggtggccgcaaccatggcaaacgagatgggtttcctggaaaaaacaaagaaagatttcggattgggaagtattacaacccagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcgaaaatggacatcggagttccccttctcgctatcggatgctattcacaagtcaaccccataactctcacagcagcccttctcttattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcgaccgggcccatctctacactgtgggaaggaaatccagggagattttggaatacaactattgcagtgtcaatggctaacatttttagagggagttacctggccggagccggacttctcttttctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaagagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagtccatgtcttttttactccccccgaaaagtgtgacccattgctgtgtgacataggggagtcgtcaccaaaccccacggttgaggcaggaccaacactccgagttctaaacttagtggaaaactggctgaacaaccacccccaattttgcataaaggttctcaacccatatatgccttccgttatagaaaaaatggaagcgctaccaaggaaatatggaggagctttggtgaggaatccactctcacgaaattccccacacgagatgtactgggtatccaatgcttccgggaacatagtgtcatcagtgaacatgatttcaagaatgttgattaacagattcacaatgagacacaagaaggccacatacgagccagatgttgatctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctatcatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttgaaaaatgaagaaatggtgacaaaccacatggaaggagaacacaagaaacttgccgaagccattttcagattaacgtaccaaaacaaagtggtgcgtgtgcaaagaccgacaccaagaggcacagtaatggacattatatcgagaagagaccaaagaggtagtggacaggttgtcacctacggcctcaatactttcaccaacatggaagcccaactgatcagacagatggagggagaaggagtcttcaagagcatccagcacctgacagtcacagaagaaattgcagtgaaaaactggttagcaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtacttgtagttccatgtagaaaccaagatgaactgattggtagggcccgaatttcccagggagccgggtggtccctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 738 - DNA, 10176 bp, Dengue virus
atgaataaccaacggaaaaaggcgagaaacacgcctttcaatatgctgaaacgcgagagaaaccgcgtgtcaacaatacaacagttgacgaagagattctcacttggaatgctgcaagggagagggccactaaagctatttatggccctagtggcgttccttcgtttcctaaccatcccaccaacagcagggatactgaagagatggggaacgatcaaaaaatcaaaggctatcagtgtactgagaggatttagaaaggaaattgggaggatgctgaacattttgaataggagacgcagaacagcgggcttccttatcatggtcattccaacagtgatggctttccatttgaccacacgcaacggggagccacacatgattgtcagcaagaatgagaaaggaaagagcctcctttttaaaacagagaatggaataaacatgtgtacccttatggccatggatttaggcgagttgtgcgaggacaccgtcacatacaagtgccccttcctcaagcaaaacgagccggaggatatagactgctggtgcaattccacatcaacctgggtgacgtacgggacgtgtagctcgacaggagagcacaggagggagaaaaggtcagtcgcacttgtcccacatgtaggaatggggctggaaacgagaactgaaacatggatgtcgtcagaaggagcatggaaacaagcccagcggattgagacatggattctgaggcacccaggattcactcttatggcagctgtcttggcgtacacaatagggacaacacatttccaaagagccctaatctttatccttttaacagccgttgctccctcgatgacaatgcgatgtataggcatatcaaaccgagacttcgtggagggagtttcaggaggaagctgggttgatatcgtcttagaacacggaagctgcgtcacaacaatggccaagaacaaaccaacattagactttgaactaataaaaacagaggccaagcaaccagcaacattgagaaaattctgcatagaagccaaattgaccaacacaacaacagaatctcgctgcccaacccaaggtgaacccagcctagtagaggagcaggacaaaagattcgtctgcaggcattcgatggtggatagaggctggggtaatggatgtggtctgtttgggaaaggaggtattgtgacctgtgcgatgttcacatgcttgaagaaaatggagggaaaagttgtgcagccagaaaacctagagtacaccatagtcataacaccccattcaggagaggaacacgctgtggggaatgatacagggaagcacggcaaggaggttaagataacacctcaaagctctatttctgaagctgaactgacagattatggcacgatcacgatggaatgctccccacgaacaggtctcgattttaatgagatggtcctgctgcagatggagagcaaagcttggctagtccacagacagtggtttctggacttacctctaccatggcttcctggagcagacacacaagggtccaattggatccagaaagagatgctagtaacatttaaaaatccccatgcgaaaagacaggacgttgttgtcttgggatcgcaagagggcgccatgcacacagcactcacaggagcaacagaaattcaaatgtcatcaggaaatatactattcatggggcatttgaagtgtagactgaggatggacaagctgcaactcaaagggatgtcgtactccatgtgcacaggaaagtttaaagttgtcaaagagatagcggaaacacaacatggaacgatagtcatcagagtgcagtatgaaggagatgactcaccatgcaagattccctttgagatcatggacttggaaaagaaacatgttttagggcgactgatcacggtcaacccaatagtgacagagaaagacagtccaatcaacatagaagcagaacccccatttggtgatagctacattgttataggagtggagccaggacagctgaaattaaactggtttaaaaaaggaagctctataggacaaatgtttgaaacaacaatgagaggagctaaaagaatggccatcttgggagacacagcttgggactttggatccatagggggagtgttcacatcagtaggaaaagcactacatcaagtttttggcgcaatctatggcgccgccttcagcggggtttcatggaccatgaagatcctcataggggtggttataacatggataggaatgaactcccgcagcacttccttatcagtgaccctggtgttagtaggaatcgtgacactatacctgggagtgatggtgcaagcggacagtggttgcgttgtaagctggaagaacaaagaactgaaatgtggaagtggaatctttgtgactgacaatgtgcacacttggacagaacagtacaaatttcaaccagactccccttcaaagctggcttctgcaattcaaaaagctcatgaggaaggaatctgtggaatccgttcagttacaaggttggaaaatctgatgtggaagcagataacaccagaattgaaccatatcctatccgaaaatgaagtcaaactgaccatcatgacaggagagattaaggggattatgcaagcagggagaagatctttgaaaccccaacccactgagctgagatactcatggaaaacttggggaaaagcgaaggtactatcaacagaactccaaaatcagactttcctcatagacggtcctgaaacaactgaatgccctaacagcaatagagcctggaactctttggaagttgaggattatggctttgggatttttaccaccaatatatggctaaagttgagagagaaacaagacatgatttgtgattcaaagttgatgtcagcagctgtcaaggacgacagagcagttcatgctgatatgggctattggatagagagcagactgaatgacacatggaagatggaaaaagcatcatttattgaggttaaaagctgccactggccaagatcacacaccctttggagcaatggagtgctggagagtgaaatgataattccaaagaatctggctggaccagtgtcgcagcacaactacagaccaggctattacacacaaacagccggaccatggcatttgggcaaactcgagatggatttcgagttctgtgaaggaaccacggtagtggtgaccgaggattgcggaaacagaggaccatccctgagaacaaccactgcctcaggaaaactcataactgagtggtgctgcagatcatgcacattaccaccactaagatacagaggagaggatggatgttggtacggaatggaaattagaccactgaaagaaagagaagagaacctggtgaactcattggttacagctggacatggcctaattgacaatttctcactagggattctgggaatggcattgctcttggaagagatgcttagaaccagagtaggaacaaaacacgccttgctgctagtggcgatctctttcgtgacactgattacagggaatatgtccttcaaggatttaggaagagtgataattatggtgggagcagccatgacggacgagatgggtatgggcgtgacatacttggcattactagctgctttcagagtcagacctacctttgcagtggggttgcttttaagaaaactcacttcaaaggaattgttgatggcaaccatcggagtcgttctcctctctcagagtaacataccaggaacagttttggaactgacagacgcaatagcattgggaataatggttcttaaaatagtgaggagcatggaaaaataccagctagcagtgaccgtcatggctatgctatgtattccaaatgtcatgatactccagcatgcatggaaagtaggttgcaccatattggcagcagtctctgtatcaccactcctcttgacttcctcacagcaaaaaacggactggataccgttagccctcacaataaaaggtctcaatccaactgctattttcttaacaactctgtctagacccggtaaaataagaagttggcctcttaatgaagctatcatggcagttggaatggtgagcatactagctagttccctcttgaaaaatgacattccaatgacgggaccactggtggcaggaggacttctcacagtgtgctatgtgcttactggcagatcggcagatttggagctagaaaaagcggcagaggtgaaatgggaagatcaagctgagatatccgggagtagcccaatcctatcagtcactatatcagaagatggtagtatgtcaataaagaatgaggaagaagagcagactttaaccatactgataaggacaggactgttagtaatatcaggactattcccagtatcaatcccaatcacagccgcggcctggtacctatgggagacaaaaaagcagagggccggagtgctgtgggacgttccttcacctccaccaatgggaaaagctgagctagaagatggcgcttacaggatcaaacagagagggatttttggacactctcaaattggggctggagtgtataaagaaggtacatttcacacgatgtggcacgtcacacgtggagctgtcctagtgcacaaagggaaaagaattgagccatcatgggcagacgtgaagaaagacttgatatcatatggaggaggctggaaactggaaggagagtggaaagaaggcgaagaagttcaggttttagcgctggaacccggaaaaaacccgagagcagtgcaaacaaaacccggcctcttcaaaaccaatacaggaacaataggagccgtatccttagacttttccccaggaacatcaggatccccaatcattgacaagaaaggaaaagtcgtgggtctctacggaaatggtgtcgtgacaagaagcggaacctatgtgagctccatagcccaaacagagaaaagcgtagaggacaatccagagattgaagatgatatatttcggaagaaaaggttaaccatcatggacttacatccaggagcagggaaaacaaaacgatatctcccagccatagttagagaagcaataagaagaggcctgagaacactgattctagcccccaccagagtagtggctgcagaaatggaggaagccctacgggggctcccaatccgttaccagactccagccatcaaggcagagcacacagggcgcgaaatcgtagacctaatgtgtcatgccacattcactatgaggttactgtcaccaattagggtaccaaactacaacctaatcataatggatgaagcccatttcacagacccagctagcatagcagctcgaggatacatctccacccgtgtggaaatgggagaagctgctggaatatttatgacagccactcctccaggcagcagggacccttttccacagagcaacgccccaataatggacgaggaaagagagattcccgaacgctcatggaattccggacatgaatggataacaaacttcaaaggcaaaacagtatggtttgtcccaagcataagagctggaaacgacatagcagcctgcttaaggaaaaatgggaaaagagtgattcagctaagtaggaaaacctttgacacagaatacaccaaaacaagaacaaacgactgggacttcgtagtcacgactgacatctcagaaatgggggcaaacttcaaagccgaaagagtgatagatccaaggagatgtatgaagccagttatattgacagaaggtgaagagcgcgtggttctggcaggacctatgccagttactcactcaagtgcagcacagagaagagggagaataggaaggaatccaaaaaatgagaacgaccaatatatttacatgggagaacccttagagaatgatgaagactgtgctcactggaaggaggcaaagatgctccttgataacatcaacacacctgaaggtatcatccccagcatgttcgagccagaacgtgagaaagttgatgccatagacggtgaataccggttaaggggggaagcaaggaaaacctttgtagacctgatgaaaagaggagacctaccagtttggctggcttacaaagtagcttcggaaggcataaactatgcagacaggaagtggtgctttgatggaatcagaaacaatcagatcctggaggagaacatggaagtggaagtttggacgaaagaaggtgagaggaaaaaactaaaacccagatggctggatgcaagaacttactcagatccgctagcactcaaagagttcaaggaatttgcggccggaaggaagtctctaaccttgagtttgatcacagaaatgggccggctcccaaccttcatgacccaaaagacaagagatgccctggacaacttggctgtactgcactctgcagaaatgggcggaagagcctataaccatgctctcagtgaactgccagaaactctagaaacattactcctgctaggtcttctggccacagtcacagggggaatctttttgttcttgatgagtggaagaggtgtagggaaaatgaccctcggaatgtgttgcataatcacggccagcggccttctgtggtatgcacagatacagccccattggattgcagcttcaataatattggagttctttctcatagtactgctaatccctgaaccagagaagcaaagaacaccccaggacaaccagttgacctatgtggtcatagccatcctgacattagtggcagccaccatggcaaacgaaatgggttttctagaaaagacaaagaaagaccttgggttgggaggctccacaatgcaacaaccagaaataaatatcttggacatagacctccgacctgcatcagcgtggacactatatgcagtggctactacgtttattacgccaatgctgaggcacagcatagaaaactcctcagtgaatgtgtcactaacagccatagcaaatcaggccacggtgcttatgggcttgggaaaaggttggccactatcaaaaatggacataggagttcctcttcttgccattggatgctactcacaggtgaatcccattaccctcacagcagcactactgctattggtggcacactatgccatcataggccctggactccaagcaaaggctaccagagaggcgcaaaaaagagcagcagccggcatcatgaagaatccaacagtagatgggattacagtgattgacctagaaccaataccctatgatccgaagtttgagaagcagttagggcaagtgatgcttttggtcctttgtgtgacacaggtgctgatgatgagaaccacgtgggctctatgcgaagccctaaccctagcaacagggcccatatcaacactgtgggaaggaaatccaggaaaattttggaacacaacaatagcagtatctatggctaatattttcagagggagttatttggccggagctggactccttttttccatcatgaggaacacaaccaccgcacgaagaggaaccggcaccataggtgaaactttaggagaaaaatggaagagtcagctaaatgcactgggaagaagtgaattccaaatatacaagaaaagtgggattcaggaagtagacagaaccctggcgaaggaaggcataaaaagaggagaaacagaccaccatgccgtttcacggggctctgcaaagctgagatggtttgttgaaagaaacatggttgccccggagggaaaggtagtagaccttggttgtggcagaggaggatggtcatattactgtggtggactaaaaaatgtgagagaagtcaaaggcctgacgaaaggaggaccaggacatgaggagcctatacctatgtcaacatacgggtggaatctagtgcgactgcagagtggagtggatgtattctttactccaccagagagatgcgacacactgctatgcgacataggagaatcatcaccaaaccccacagtagaggccggacgaacactgagagttctcaatctagtagaaaattggctgggaagcaatacacagttttgcgtaaaagtccttaacccttacatgccatcagttatagagagaatggaagcactacagagaaagtttggaggcgctctagtccgcaatccactctcaaggaattccacacacgagatgtactgggtgtccaacgcttctggaaatattgtatcttctgtgaacatgatttcaaggatgttgataaatagattcacaatgaggcacaagaaagccacctacgagcctgatgttgatcttggaagtggaacacgcaacatcggaattgagtgtgaaacgccaaatatggacataattggaaaacggattgagaaaataaaacaagaacatgaaacgtcatggctctatgaccaagatcatccatacaaaacatgggcataccatggcagttatgagacgaaacaaacaggatcagcatcatcaatggtaaacggagtggtcaggctattgacaaaaccctgggatgtcattcccatggtgacgcaaatggcaatgacagacacaaccccctttggacagcagcgtgttttcaaagaaaaagtagacacaagaacccaggaaccaaaagagggcacgaaaaaattgatgagaatcacagcagagtggctttggggtgagttaggaaggagaaagaagcccagaatctgcacaagagcagagttctgtaataaagtgagaagcaacgcagctctgggggctgtgttcactgatgagaacaagtggaagtcagcacgcgaagcggtcgaagatgaaagattttgggagctggtggaaaaagagagaaaccttcaccttgacggaaagtgtgaaacatgtgtgtacaacatgatgggaaaaagagagaagaaactgggagaatttggcaaagcaaaaggcagcagagccatatggtatatgtggctaggtgcccgctttttagagtttgaggctctaggttttttgaacgaagaccattggttctctagagaaaattctctaagtggagtggaaggagaaggactgcacaagttgggctacatcctaagagacatcagcaggaaagcaggaggagcaatgtacgcagatgacactgctggttgggacacaaggatcacatctgaggatctgaagaatgaagaaatgataacagaccaaatggaagggagacataagaagctggcagaggccatattcaaactaacatatcagaataaggtagttcgcgtccaaagaccaaccccaagagggacggtgatggacatcatttcaaggagagaccaaagaggcagtgggcaggtggggacgtacggtctcaacaccttcactaacatggaagcacaactgataaggcagatggagggggaaggactctttaagagcatactgcacttaacaccccaagaggaaactgctgtccacgcttggctagttagagagggacgcgaacgcctcgcaagaatggcaatcagtggagacgactgcgtcgtgaaaccactagatgacagattcgccagagctttaacagcattgaatgacatgggaaaagtgaggaaagacatacaacagtgggaaccctcaaaaggatggagtgattggacccaagtgcctttttgctctcaccactttcatgaattaataatgaaagatggtcgcaagcttgtagtcccatgcagaaaccaggatgaactgataggcagagcgcgcatctcccagggggcaggatggtccttgagagagacagcctgtttggggaagtcatatgcccagatgtggagcctgatgtacttccacaggcgtgatctcaggttggctgctaatgccatatgttcagcagttccatcacattgggttccaactagcaggacaacttggtccatacatgctagtcatgaatggatgacgacggaagacatgttagcagtctggaacagggtgtggatccaggacaacccatggatggaagacaagacccccgtggaatcatgggaagacataccatatctagggaaaagggaggaccagtggtgtggttccctgattggcttaacaagcagggccacttgggcaaagaacattcaaacagccataaaccaggtcagagctctcattggtgaggaggaatacatggactacatgccctcaatgaaaaggttcaggagtgaagaggaggaatcaggagtcctgtggtaa

SEQ ID NO: 739 - DNA, 10176 bp, Dengue virus
atgaataaccaacggaaaaaggcgagaaactcgcctttcaatatgctgaaacgcgagagaaaccgcgtgtcaacaatacaacagttgacgaagagattctcacttggaatgctgcaagggagagggccactaaagctatttatggccctagtggcgttccttcgtttcctaaccatcccaccaacagcagggatactgaagagatggggaacgattaaaaaatcaaaggctatcagtgtgctgagaggatttagaaaggaaattggaaggatgctgaacattttgaacaggagacgcaggacagcgggcttcctcattatggtcattccaacagtgatggcttttcatttgaccacacgcaacggggagccacatatgattgtcagcaagaatgagaaaggaaagagcctccttttcaaaacagagaatggaataaacatgtgcacccttatggccatggatctaggcgagttgtgtgaggacaccgtcacatacaagtgtccctttctcaagcaaaatgagccagaggatatagactgctggtgcaactccacatcaacctgggtgacgtacgggacgtgtagctcgacaggagagcataggagggagaagagatcagtcgcacttgtcccacatgtaggaatggggttggaaacgagaactgaaacatggatgtcatcagaaggagcatggaaacaagcccagcggattgagacatggattttaaggcacccaggtttcactcttatggcagctgttctggcgtacacaatagggacaacacatttccaaagagccctaatctttattcttttaactgccgttgctccctcaatgacaatgcgatgtataggcatatcaaaccgagactttgtggagggagtatcaggaggaagctgggttgatattgtcttagaacatggaagctgcgtcacaacaatggccaagaacaaaccaacattggactttgaactaataaaaacagaggccaagcaaccagcaacattgagaaaattctgcatagaagccaaattgaccaacacaacaacggaatctcgctgcccaacccaaggtgaacccagcctagtagaggagcaggacaaaagattcgtttgtaggcattcgatggtagatagaggttggggtaatggatgtggtctgtttggaaaaggaggcattgtgacctgtgcgatgttcacatgcttgaagaaaatggagggaaaagttgtgcagccagaaaacctagagtacaccatagtcataacaccccactcaggagaggaacatgctgtggggaaagacacagggaagcacggcaaggaggttaagataacacctcaaagctctattgctgaagctgaactgacaggttatggcacgattacgatggaatgctccccaagaacaggtctcgattccaatgagatggtcctgctgcaaatggagaacaaagcatggctagttcatagacagtggtttctggacttacctttaccatggcttcctggagcagacacacaagggtccagttggatccagaaagaaatgctagtaacattcaaaaacccccatgcgaaaagacaagacgttgtcgtcttgggatcgcaagagggcgccatgcacacagcactcacaggggcaacagaaattcagatgtcatcgggaaatatactatttatggggcatttgaagtgtagactgaggatggacaagctgcaactcaaagggatgtcgtactccatgtgcacaggaaagttcaaagttgtcaaagagatagcggaaacacaacatggaacgatagtcatcagagtgcagtatgaaggagaagactcaccgtgcaagatcccttttgagatcatggacttggaaaagaaacatgtcttagggcgactgattacggtcaacccaatagtgatagggaaagacagcccaatcaacatagaagcagaacctccttttggtgacagctatattgtcataggagtggagccaggacagctgaaattgaactggttcaaaaaaggaagctctattggacaaatgtttgaaacgacaatgagaggagctaagagaatggctatcttgggagacacagcttgggactttggatccatagggggagtgttcacgtcagtagggaaagcactacatcaagtttttggcgcgatctatggcgccgcctttagcggggtttcatggactatgaagatcctcataggggtggttataacatggataggaatgaactcccgcagcacttccttgtcagtgaccctggtgttagtgggaatcgtgacactatacctgggagtgatggtgcaagcggacagtggttgcgtagtaagctggaagaacaaagaaatgaaatgtggaagtgggatctttgtaactgacaatgtgcacacctggacggaacaatacaaattccaaccagactccccttcaaagctggcttccgcaattcaaaaagctcatgaggaaggaatctgtggaatccgttcagtgacaaggttggaaaatctgatgtggaggcagataacaccagaattgaaccacatcctatccgaaaatgaagtcaaactgaccatcatgacaggagagattaaggggatcatgcaagcagggagaagatctttgaaacctcaacccactgagctgagatactcatggaaaacttggggaaaagcgaaagtactatcaacagaactccaaaatcaaactttcctcatagacggtcctgaaacaactgaatgccctagcagcaatagagcctggaactctttggaagttgaagattatggctttgggatttttaccaccaatatatggctaaagttgagagagaaacaagacacggtttgtgactcaaagttgatgtcagcagctgtcaaggacgacagggcagttcatgctgatatgggctattggatagagagcagactgaatgatacatggaagatggaaaaagcatcatttattgaggtcaaaagctgccactggccaagatcacacaccctttggagcaacggagtgctagagagtgaaatgataattccaaagaatctggctggaccagtctcgcagcataaccacagaccaggctattacacgcaaacagccggaccatggcacttgggcaaactcgagatggatttcgagttttgtgagggaaccacggtagtggtgaccgaggattgcggaaacagaggaccatccttgagaacaaccactgcctcaggaaaactcataactgagtggtgctgcagatcatgcacattaccaccactaagatacagaggagaggatggatgttggtacggaatggaaatcagaccactgaaagaaaaagaagagaacctggtgaactcattggttacagccggacatggccaaattgacaatttttcactagggattctgggaatggcattgctcttggaagagatgcttagaaccagagtaggaacgaagcacgccttgctgctagtggcgatctctttcgtgacactgattacagggaatatgtccttcaaggatttgggaagagtgataatcatggtgggagcagccatgacggacgagatgggtatgggcgtgacatacttggcattactagccgctttcagagtcagacctacctttgcagtggggttgcttttaagaaaacttacttcaaaggaattgttgatggcaaccatcggagttgtcctcctctctcagagtaacataccaggaacagttttggaactaactgacgcaatagcattaggaataatggttcttaaaatagtgaggagcatggaaaaataccagctagcagtgaccgtcatggctatgctatgtattccaaatgtcatgatactccagcatgcatggagagtgggctgcaccatattggcagcagtttctgtatcaccactcctcttgacttcctcacaacaaaaaacggactggataccgttagccctcacaataaaaggtcttaatccgactgctattttcttaacaactctgtctagacccaataaaacaagaagttggcctcttaatgaagctatcatggcagtcggaatggtgagcatactagctagttcccttctgaaaaatgacattccaatgacgggaccactggtggcaggaggacttctcacagtgtgctatgtgctcactggcagatcggcagacttggagctagaaaaagcggcagaggtaaaatgggaagatcaagctgagatatctgggagtagcccaatcctatcagtcactatatcagaagatggtagcatgtcaataaagaatgaggaagaagaacagactttaaccatactaataaggacaggactgttagtaatatcaggactattcccagtgtcaatcccaatcacagccgcggcttggtacctatgggagacaaaaaaacagagggccggagtgctatgggacgttccttcacctccaccaatgggaaaagctgagctagaagatggcgcttacagaatcaaacagagagggattttcggatactctcaaattggggctggagtgtacaaagaaggcacatttcacacgatgtggcacgtcacacgtggagctgtcctagtgcacaaagggaaaagaattgagccatcatgggcagacgtgaagaaagacctgatatcatatggaggaggttggaaactggaaggagagtggaaagaaggcgaagaagttcaggttttagcgctggaacctggaaaaaacccgagagcagtgcaaacaaaacccggactcttcaaaaccaacacaggaacaataggagccgtatccttagacttctccccaggaacgtcaggatccccaatcattgacaagaaaggaaaagtcgtgggtctctacggaaatggtgtcgtgacaaggagcggaacctatgtgagctccatagcccaaacagagaaaagcgtggaggacaatccagagattgaggatgatatatttcggaagaaaaggctaaccatcatggacttacatccaggagcgggaaaaacaaaacgatatctcccagccatagttagagaagcaataagaagaggcctgagaacactaattctggctcccaccagagtagtggctgcagaaatggaggaagccctacggggcctcccaatccgttaccagactccagccatcaaggcagagcacacagggcgcgaaatcgtggacctaatgtgtcatgccacattcaccatgaggttactatcgccaattagggtaccaaactacaacttaatcataatggatgaagcccatttcacagacccagctagcatagcagctcgaggatacatctccacccgtgtagaaatgggagaagctgctggaatatttatgacagccactcctccaggcagcagggacccttttccacagagcaatgccccaatagtggacgaggaaagagagattcccgagcgctcatggaattccggacatgaatggataacaaacttcaaaggtaaaacagtatggtttgtcccaagcataagagctggaaatgacatagcagcctgcttaaggaaaaatgggaaaagagtgatccagctaagtagaaagacctttgacacagaatacaccaaaacaagaacaaatgactgggacttcgtggtcacgactgacatttcggaaatgggggcaaacttcaaagctgaaagagtgatagatccaaggagatgcatgaagccagttatactgacagacggtgaagagcgcgtggttctggcaggacccatgccagtcacccactcaagtgcagcacagagaagagggagaataggaaggaatcccaaaaatgagaacgaccaatatatttacatgggagaacctttagagaatgatgaagactgtgctcactggaaggaggcaaagatgctccttgataacatcaacacacctgaaggcatcatccccagcatgttcgagccagaacgtgagaaagttgatgccatagacggtgaataccggttaaggggggaagcaaggaaaacctttgtggacctgatgaaaagaggagacctaccagtctggctggcctacaaagtagcttcggaaggtataaactatgcagacaggaagtggtgctttgatggaatcagaaacaatcagatcctggaggagaacatggaagtggaagtttggacgaaggaaggtgagaggaaaaaattaaaacccagatggttggatgcaagaacttactcagatccgctagcactcaaagagttcaaggaattcgcggccggaaggaagtctctaaccttgagtttgatcacagaaatgggccggcttccaaccttcatgacccaaaaaacaagagatgccttggacaatttggctgtactgcactccgcagaaatgggtggaagagcctataaccatgccctcagtgaattgccagaaaccttagaaacactacttctgctaggtcttctggccacagtcacagggggaatctttctgttcttgatgagtggaagaggtgtagggaaaatgacccttggaatgtgttgcataatcacggccagcggccttctgtggtacgcacagatacagccccactggatagcagcttcaataatactagagttctttctcatagtactgttaatccctgaaccagagaagcaaagaacaccccaggacaatcagctgacctatgtggtcatagccattctgacattagtggcagccaccatggcaaacgaaatgggttttctagaaaagacaaagaaagaccttgggttgggaggcaccacaacgcaacagccagaaacaaatatcttggatatagacctccgacctgcatcagcgtggacactgtatgcagtggctaccacgtttgtcacgccaatgctgaggcatagtatagaaaactcttcagtgaacgtgtcactaacagctatagcaaatcaggccacggtgcttatgggcttgggaaaaggttggccactatcaaaaatggacataggagttcctcttctcgctattggatgttactcgcaggtgaatcccataaccctcacagcagcactactgctactagtggcacactatgccattataggccccggattgcaagcaaaggctaccagagaggcgcagaaaagagcagcagccggcatcatgaagaatccaacagtagatgggattacagtgattgacctagaaccaataccctatgatccgaagtttgagaagcagttggggcaagtgatgcttttggtcctttgtgtgacacaggtgctgatgatgagaaccacgtgggctctatgcgaagccctaaccctagcaacagggcccatatcaacactgtgggaaggaaacccagggaaattctggaacacaacaatagcagtctctatggctaatatttttagagggagttacttggctggagctggactcctcttttccatcatgaggaatacaaccagcgcacggagaggaaccggcaccataggtgaaactttaggagaaaaatggaagagtcggctaaatgcactgggaagaagtgaattccagatatacaagaaaagtgggattcaggaggtagacagaaccctggcgaaggaaggcataaaaagaggagaaacagaccaccatgccgtttcacgaggttctgcaaagctgagatggtttgttgaaagaaacatggttgccccagaaggaaaggtagtagaccttggttgtggcagaggaggatggtcatattactgtggtggactaaaaaatgtgagagaagtcaaaggcctgacgaaaggaggaccaggacacgaggagcccatacccatgtcaacatatgggtggaatctagtgcgactgcagagtggagtggatgtattctttactccaccagagagatgcgacacactgctatgcgacataggagaatcgtcaccaaaccctacagtggaggccggacgaacactgagagttctcaatttagtggaaaattggctgggaagcaacacacagttttgcgtaaaagtcctcaacccttacatgccatcagtcatagagagaatggaaacattacagagaaagttcggaggcgccctagtccgcaatccactctcaaggaattcaacacatgagatgtactgggtgtccaacgcttctggaaatatcgtatcttctgtgaacatgatttcaaggatgttgataaatagattcacaatgaggcacaaaaaagtcacctacgagcctgatgttgatcttggaagtggaacacgcaacattggaattgagtgtgaaacgccaaatatggacataattgggaaacggattgagaagataaaacaagaacatgaaacgtcatggcactatgaccaagatcatccatacaaaacatgggcataccacggcagttatgagacgaaacaaacaggatcagcatcatcaatggtaaacggagtggtcaggctgttgacaaaaccctgggatgtcattcccatggtgacgcaaatggcaatgacagacacaaccccctttggacagcagcgtgttttcaaggaaaaagttgacacaagaacccaggaaccaaaagagggcacgaaaaaattgatgagaatcacagcagagtggctttggggtgagttaggaaggagaaagaagcccagaatctgtacaagagcagagttctgcaacaaagtgagaagcaacgcagctctgggggctgtgttcaccgatgagaacaagtggaagtcagcacgcgaagcggtcgaagatgaaagattctgggagctggtggaaagagagagaaaccttcaccttgacggaaagtgtgaaacatgtgtgtacaacatgatgggaaaaagagagaagaaactgggagaatttggcaaagcaaaaggcagcagagccatatggtacatgtggctaggtgctcgctttttagaatttgaggccctaggttttttgaacgaggaccattggttctctagagaaaactctcttagtggagtggaaggagaaggactgcacaagctgggctacatcctaagagacatcagcaggaaagcaggaggagcaatctacgcagatgacactgctggctgggacacaaggatcacatctgaggatctgaagaatgaagaaatgataacaggccaaatggaagggagacataagaagctggcagaagccatattcaaactgacatatcagaataaggtagttcgcgttcaaaggccaaccccaagaggcacggtgatggatatcatttcaaggagagatcaaagaggcagtgggcaggtggggacgtacggtctcaacaccttcaccaatatggaagcacaactgataaggcagatggaaggggaaggactcttcaagagcatcctacatttaacaccccaagaggaaattgctgtccacacttggctagttagagagggacgcgaacgcctcgcaagaatggcaatcagtggagatgactgcgtcgtgaaaccactagatgatagattcgccagagctttaacagcattgaatgacatgggaaaagtgaggaaagatatacaacagtgggaaccctcaaaaggatggagtgattggactcaagtgcccttttgctctcaccactttcatgaactaataatgaaagatggtcgcaagcttgtagtcccatgcagaagccaggatgaactgataggcagagcgcgtatctcccagggggcaggatggtccttgagagagacagcctgtttggggaagtcatatgcccagatgtggagcctgatgtatttccacaggcgtgatctcaggctggctgctaatgccatctgttcagcagttccatcacattgggttccaaccagcaggacgacttggtccatacatgctagtcatgaatggatgacgacggaagacatgttagcagtttggaacagggtgtggatccaggacaatccatggatggaagacaagacccccgtggaatcatgggaagacataccatacctagggaaaagggaagaccagtggtgtggttctttgattggcttaacaagcagggccacctgggcaaggaacattcagacagccataaaccaagtcagagccctcattggtgaggaggaatacacggactacatgccctcaatgaaaaggttcaggagtgaagaggaggagtcaggagtcctgtggtaa

SEQ ID NO: 740 - DNA, 10176 bp, Dengue virus
atgaataaccaacggaaaaaggcgagaaacacgcctttcaatatgctgaaacgcgagagaaaccgcgtgtcaacaatacaacagttgacgaagagattctcacttggaatgctacaagggagagggccactaaagctatttatggccctagtagcgttcctccgtttcctaactatcccaccaacagcagggatattgaagagatggggaacgatcaaaaaatcaaaggctatcagtgtactgagaggatttagaaaggaaattgggaggatgctgaacattttgaacaggagacgcagaacagcgggcttcctcatcatggttattccaacagtgatggcttttcatttgaccacacgcaacggggagccacatatgattgtcagcaagaatgagaaaggaaagagcctcctttttaaaacagagaatggaataaacatgtgcacccttatggccatggatctaggcgagttgtgcgaggacaccatcacatataagtgtccctttctcaagcaaaacgagccagaggatatagactgctggtgcaactccacatcaacctgggtgacgtacgggacatgtagctcgacaggagagcataggagggagaaaagatcagtcgcacttgtcccacatgtaggaatggggttggaaacgagaactgaaacatggatgtcatcagaaggagcatggaaacaagctcagcggattgagacatggattttgaggcacccaggtttcactcttatggcagctgttttggcgtacacaatagggacaacacatttccaaagagccctaatctttatccttttaactgccgttgctccctcaatgacaatgcgatgtataggcatatcaaaccgagactttgtggagggagtttcaggaggaagctgggttgatatcgttttagaacatggaagctgcgtcacaacaatggccaagaacaaaccaacattggactttgaactaataaaaacagaggccaagcaaccagcaacattgagaaaattctgcatagaagccaaattgaccaacacaacaacggaatcccgctgcccaacccaaggtgaacccagcctagcagaggagcaggacaaaagattcgtttgcaggcattcgatggtggatagaggttggggtaatggatgtggtctgtttgggaaaggaggtattgtgacctgtgcgatgttcacatgcttgaagaaaatggagggaaaagttgtgcagccagaaaacctagagtacaccatagtcataacaccccattcaggagaggaacatgctgtggggaatgacacagggaagcacggcaaggaggttaagataacgcctcaaagctctattgccgaagctgaactgacagattatggcacgatcacgatggaatgttccccacgaacaggtctcgatttcaatgagatggtcctgctgcaaatggagaacaaagcatggctagttcatagacagtggtttctggacttacctctaccatggcttcttggagcagatacacaagagtctaattggatccagaaagagatgctagtaacattcaaaaacccccacgcgaaaagacaagacgttgtcgtcttgggatcgcaagagggcgccatgcacacagcactcacaggagcaacagaaattcaaatgtcatcgggaaatatactatttatggggcacttgaagtgcagactgaggatggacaagctgcaactcaaagggatgtcatactccatgtgcacaggaaagttcaaagttgtcaaagagatagcggaaacacaacatggaacaatggtcatcagagtgcagtatgaaggagatgactcaccatgcaagattccttttgagatcatggacttggaaaagaaacatgttttagggcgactgattacggtcaacccaatagtaatagagaaagacagcccaatcaacatagaagcggaacctccatttggtgatagctacattatcataggagtggagccaggacagctgaaattaaactggttcaaaaaaggaagctctataggacaaatgtttgaaacaacaatgagaggagctaaaagaatggccatcttgggagacacagcttgggactttggatccatagggggagtgttcacatcagtagggaaagcactacatcaagttttcggcgcgatctatggcgccgccttcagcggggtttcatggactatgaagatcctcataggggtggttataacatggataggaatgaactcccgcagcacctccttgtcagtgaccctggtgctagtaggaatcgtgacactatacctgggagtgatggtgcaagcggatagtggttgcgttgtaagctggaagaacaaagaactgaaatgtggaagtgggatctttgtaactgacaatgtgcacacctggacggaacaatacaaatttcaaccagactccccttcaaagctggcttccgcaattcaaaaagctcacgaggaaggaatctgtggaatccgttcagtgacaaggctggaaaatctgatgtggaagcagataacaccagaattgaaccacatcctatccgaaaatgaagttaaactgaccatcatgacaggagagattaaggggatcatgcaagcagggagaagatctttgaaacctcaacccactgaactaagatactcatggaaaacctggggaaaagcgaaagtactatcaacagaaccccaaaatcagactttcctcatagacggtcctgaaacaactgaatgccctaacagcaatagagcctggaactctttggaagttgaggactatggctttgggatttttaccaccaatatatggctaaagttgagagagaaacaagacatggtctgtgactcaaagttgatgtcagcagctgtcaaggatgacagagcagttcatgctgacatgggctattggatagagagcagactgaatgacacatggaagatggaaaaagcatcatttattgaggtcaaaagctgctactggccaaggtcacacaccctctggagcaacggagtgctagagagtgaaatgataattccaaagaatctggctggaccagtgtcgcagcataactacagaccaggctatcacacgcaaacagccggaccatggcatttgggcaaactcgagatggatttcgagttttgtgagggaaccacggtagtggtgaccgaggattgcggaaacagaggaccatccttgagaacaaccactgcctcaggaaaacttataactgagtggtgctgcagatcatgtacattaccaccactaagatacagaggagaggatggatgttggtacggaatggaaattagaccactgaaagaaaaagaagagaacctggtgaactcattggtaacagccggacatggccaaattgacaatttttcactagggattctggggatggcattgctcttggaagagatgcttagaaccagagtaggaacaaagcatgccttgctgctagtggcgatctctttcgtgacactgattacagggaatatgtccttcaaggatctgggaagagtgataatcatggtgggagcagccatgacggacgagatgggcatgggcgtgacatacttggcattactagccgctttcagagtcagacctacctttgcagtggggttgcttttaagaaaacttacttcaaaggaattgttgatggcaaccatcggagtcgtcctcctctctcagagtaacataccaggaacagttttggaactaactgacgcaatagcattgggaataatggttcttaaaatagtgaggagcatggaaaaataccaactagcagtaaccgtcatggctatgctatgtattccaaatgtcatgatactccagcatgcatggaaagtgggttgcaccatattggcagtagtttctgtatcaccactcctcttgacttcctcacaacaaaaaacggactggataccgttagtcctcataataaaaggtctcaatccaactgctattttcttgacaactctgtccagacccaataaaataagaagttggcctcttaatgaagctatcatggcagtaggaatggtgagtatactagcaagttcccttctgaaaaatgacattccaatgacgggaccactggtggcaggaggacttctcacagtgtgctatgtgcttactggcagatcggcagacttggagctagaaaaagcggcagaggtgaaatgggaagatcaagctgagatatctgggagtagcccaatcctatcagtcaccatatcagaagatggtagcatgtcaataaagaatgaggaagaagaacagactttaaccatactgataaggacaggactgttggtaatatcaggactattcccagtgtcaatcccaatcacagctgcggcttggtacctatgggagacaaaaaagcagagggccggagtgctgtgggatgttccttcacctccaccaatgggaaaagctgagctagaagatggcgcttacagaatcaaacagagagggattttcggatattctcaaattggggctggagtgtataaagaaggcacatttcacacgatgtggcacgtcacacgtggagccgtcctagtgcacaaagggaaaagaattgagccatcatgggcggacgtgaagaaagacttgatatcatacggaggaggctggaaactggaaggagaatggaaagaaggcgaagaagttcaggttttagcgctggaacctggaaaaaacccgagagcagtgcaaacaaaacccggcttcttcaaaaccaatacaggaacaataggagccgtatccttagacttctccccaggaacatcaggatccccaatcattgacaagaaaggaaaagtcgtgggtctctacggaaatggtgtcgtgacaagaagcggaacctatgtgagctctatagcccaaacagagacaagcgtggaggacaatccagagattgaagatgatatatttcggaagaaaaggctaaccatcatggacttacatccaggagcgggaaaaacaaaacgatatctcccagccatagttagagaagcaataagaagaggcctgagaacactgattctggcccccaccagagtagtggctgcagaaatggaggaagccctacgggggctcccaatccgttaccagactccagccattaaggcagagcacacagggcgcgaaatcgtagacctaatgtgtcatgccacattcaccatgaggttactatcaccaattagggtaccaaactacaacttaatcataatggatgaagcccatttcacagacccagctagcatagcagctcgaggatacatctccacccgtgtagaaatgggagaagccgctggaatatttatgacagccactcctccaggcagcagggacccgtttccacagagcaatgccccaatagtggacgaggaaagagagattcccgagcgctcatggaattccggacatgaatggataacaaattttaaaggcaaaacagtgtggtttgtcccaagcataagagctggaaacgacatagcagcctgtttaaggaaaaatgggaaaagagtgattcagctaagcagaaagacctttgatacagaatacaccaaaacaagaacaaatgactgggacttcgtggtcacgactgacatttcggaaatgggggcaaacttcaaagctgaaagagtgatagatccaaggagatgtatgaagccagttatactgacagacggtgaagagcgcgtggttctggcaggacccatgccagtcactcactcaagtgcagcacagagaagaggaaggataggaagaaatcccaaaaatgagaacgaccaatacatttacatgggagaacctttagagaatgatgaagactgtgctcactggaaggaggcaaagatgctccttgataacatcaacacaccagaaggtatcatccccagcatgttcgagccagaacgtgagaaagttgatgccatagacggtgaataccggctaaggggggaagcaaggaaaacttttgtggacctgatgaaaagaggagacctaccagtttggctggcttacaaagtagcttcggaaggcataaactatgyagacaggaagtggtgctttgatggaataagaaacaatcagatcctggaggagaacatggaagtggaagtttggacaaaagaaggtgagaggaaaaaactaaaacccagatggttggatgcaagaacttactcagatccgctagcactcaaagagttcaaggaatttgcggccggaaggaagtctctaaccttgaatttaatcacagaaatgggccggcttccaaccttcatgacccaaaagacaagagatgccctggacaacttggctgtactgcactctgcagaaatgggtggaagagcctataaccatgctctcagtgaattgccagaaactctagaaacattacttctgctaggccttctggccacagtcacagggggaatctttctgttcttgatgagtggaagaggtgtagggaaaatgaccctcggaatgtgttgcataatcacggccagcggccttctgtggtatgcacagatacagccccattggatagcagcttcaataatattagagttcttcctcatagtactgctaatccctgaaccagagaagcaaagaacaccccaggacaatcagctgacctatgtggttatagccatcctgacgttagtggcagccaccatggcaaacgaaatgggttttctagaaaagacaaagaaagaccttgggttgggaggcatcacaacgcaacaaccagaaataaatatcttggacatagacctccgacctgcatcagcgtggacactgtatgcagtggctactacgtttatcacgccaatgctgaggcacagtatagaaaactcttcagtgaatgtgtcactaacagctatagcaaatcaggccacggtgctcatgggcttgggaaaaggttggccactatcaaaaatggacataggagttcctcttcttgccattggatgctactcacaggtgaatcccataaccctcacagcagcactattcctactagtggcacactatgccatcataggccctggactccaagcaaaggctaccagagaggcgcagaaaagagcagcagccggcattatgaagaatccaacagtagatgggattacagtgattgacctagaaccaataccctatgatcctaagtttgagaagcagttagggcaagtgatgcttttagtcctttgtgtgacacaggtgctgatgatgagaaccacgtgggctctatgcgaagccctaaccctagcaacggggcccatatcaacactgtgggaaggaaatccaggaaaattttggaacacaacaatagcagtctctatggctaacattttcagagggagttatttggctggagctggactcctcttttccatcatgaggaatacaaccagcgcacgacgaggaaccggcaacataggtgaaactttaggagaaaaatggaagagccggctaaatgcactgggaagaagtgaattccagatatacaagaagagtgggattcaggaggtagacagaaccctggcgaaggagggcataaaaagaggagaaacagaccaccatgccgtttcacggggctctgcaaagctgagatggtttgttgaaagaaacatggtcgccccagaaggaaaagtagtagaccttggttgtggcagaggaggatggtcatattactgtggtggactaaaaaatgtgagagaagtcaaaggcctgacgaaaggaggaccaggacatgaggagccaatacctatgtcaacatatgggtggaatctagtgcgactgcagagtggagtggatgtattctttattccaccagagagatgcgacacactgctatgcgacataggagaatcgtcaccaaaccccacagtggaggccggacgaacactgagagttctcaatctagtggaaaattggctgggaagcaacacacagttttgcgtaaaagtcctcaacccttacatgccatcagtcatagagagaatggaagcattgcagaggaaatttggaggcgctctagtccgcaatccactctcaaggaattctacgcatgagatgtattgggtgtccaacgcttctggaaatattgtatcttctgtgaacatgatttcaaggatgttgataaatagattcacaatgaggcacaagaaagccacctatgagcctgatgttgatcttgggagtggaacacgcaacattggaattgagtgtgaaacgccaaatatggacataattggaaaacggattgagaaaataaaacaagaacatgaaacgtcatggcactatgaccaagatcatccatacagaacatgggcataccacggcagttatgagacgaaacaaacagggtcagcatcatcaatggtaaatggagtggtcaggctgttgaccaaaccctgggatgtcattcccatggtgacgcaaatggcaatgacagacacaaccccctttggacagcagcgtgttttcaaggaaaaagttgacacaagaacccaggaaccaaaagagggcacgaaaaaattgatgagaattacagcagagtggctttggggtgagttaggaaggagaaagaagcccagaatctgtacaagagcagagttctgcaacaaagtgagaagcaacgcagctctgggggctgtgttcactgatgagaacaagtggaagtcagcacgcgaagcggtcgaagatgaaagattttgggagctggtggaaagagagagaaacctccaccttgacggaaagtgtgaaacatgcgtgtacaacatgatgggaaaaagagagaagaaactgggagaattcggcaaagcaaaaggcagcagagccatatggtacatgtggctaggtgcccgctttttagaatttgaggccctaggttttttgaacgaagaccattggttctctagagaaaactctcttagtggagtggaaggagaaggactgcacaagctgggctacatcctaagagacatcagcaagaaagcaggaggagcaatgtacgcagatgacactgctggttgggacacaaggatcacatctgaggatctaaagaatgaagaaatgataacaggccaaatggaagggaaacataagaagctggcagaggccatattcaaactaacatatcagaataaggtggttcgcgtccaaaggccaaccccaagaggcacggtgatggacatcatttcaaggagggaccaaagaggcagtgggcaggtggggacgtacggtctcaacaccttcaccaatatggaagcacaactaataaggcagatggaaggggaaggactctttaagagcatcctgcatttaacaccccaagaggaaatcgctgtccacgcttggctagttagagagggacgcgaacgcctctcaagaatggcaatcagtggagatgactgtgtcgtgaaaccactagatgacagatttgccagagctttaacagcattgaatgacatgggaaaagtgaggaaagacatacaacagtgggaaccctcaaaaggatggagcgattggacccaagtgcccttttgctctcaccactttcatgaactaataatgaaagatggtcgcaagcttgtagtcccatgcagaagccaggatgaactgataggcagagcgcgcatctcccagggggcaggatggtccttgagagagacagcctgtttggggaagtcatatgcccagatgtggagcctgatgtacttccacaggcgtgatctcaggctggctgctaatgccatctgttcagcagttccatcacattgggttccaaccagcaggacaacttggtccatacatgctagtcatgaatggatgacgacggaagacatgttagcagtctggaacagggtgtggatccaagacaatccatggatggaagacaaaacccccgtggaatcatgggaagacataccatacctaggaaaaagggaagaccagtggtgcggttccctgattggcctaacaagcagggccacctgggcaaggaacattcaaacagccataaaccaagtcagagccctcattggcgaggaggaatacacggattacatgccctcaatgaaaaggttcaggagtgaagaggaggagtcaggagtcctgtggtaa

SEQ ID NO: 741 - DNA, 10176 bp, Dengue virus
  misc_feature (3657)..(3657): n is a, c, g, or t
atgaataaccaacggaaaaaggcgagaaacacgcctttcaatatgctgaaacgcgagagaaaccgcgtgtcaacaatacaacagttgacgaagagattctcacttggaatgctgcaagggagagggccactaaagctatttatggccctagtggcgttccttcgtttcctaaccatcccaccaacagcagggatactgaagagatggggaacgatcaaaaaatcaaaggctatcagtgtgctgagaggatttagaaaggaaattggaaggatgctgaacattttgaacaggagacgcaggacagcgggcttcctcatcatggtcattccaacagtgatggcttttcatttgaccacacgcaacggggagccacatatgattgtcagcaagaatgagaaaggaaagagcctccttttcaaaacagagaatggaataaacatgtgcacccttatggctatggatctaggcgagttgtgcgaggacaccgtcacatacaagtgtccctttctcaagcaaaacgagccagaagatatagactgctggtgcaactccacatcaacctgggtgacgtacgggacgtgtagctcgacaggagagcataggagggagaaaagatcagtcgcacttgtcccacatgtaggaatggggttggaaacgagaactgaaacatggatgtcatcagaaggagcatggaaacaagcccagcggattgagacatggattttgaggcacccaggtttcactcttatggcagctgttctggcgtacacaatagggacaacacatttccaaagagccctaatctttattcttttaactgccgttgctccctcaatgacaatgcgatgtataggcatgtcaaaccgagactttgtggagggagtatcaggaggaagctgggttgatattgtcttagaacatggaagctgcgtcacaacaatggccaagaacaaaccaacattggactttgaactaataaaaacagaggccaagcaaccagcaacattgagaaaattctgtatagaagccaaattgaccaacacaacaacggaatctcgctgcccaacccaaggtgaacccagcctagtagaggagcaggacaaaagattcgtttgcaggcattcgatggtagatagaggttggggtaatggatgtggtctgtttggaaaaggaggcattgtgacctgtgcgatgttcacatgcttgaagaaaatggagggaaaagttgtgcagccagaaaacctagagtacaccatagtcataacaccccattcaggagaggaacatgctgtggggaatgacacagggaagcatggcaaggaggttaagataacacctcaaagctctattgctgaagctgaactgacaggttatggcacgattacgatggaatgctccccacgaacaggtctcgatttcaatgagatggtcctgctgcaaatggagaacaaagcatggctagttcatagacagtggtttctggacttacctttaccatggcttcctggagcagacacacaagggtccaattggatccagaaagaaatgctagtaacattcaaaaacccccatgcgaaaagacaagacgttgtcgtcttgggatcgcaagagggcgccatgcacatagcactcacaggggcaacagaaattcagatgtcatcgggaaacatactatttatggggcatttgaagtgtagactgaggatggacaagctgcaactcaaagggatgtcgtactccatgtgcacaggaaagttcaaagttgtcaaagagatagcggaaacacaacatggaacgatagtcatcagagtgcagtatgaaggagaagactcaccgtgcaagatcccttttgagatcatggacttggaaaagaaacatgtcttagggcgactgattacggtcaacccaatagtgatagggaaagacagcccaatcaacatagaagcagaacccccttttggtgacagctatattgtcataggagtggagccaggacagctgaaattaaactggttcaaaaaaggaagctctattggacaaatgtttgaaacgacaatgagaggagctaaaagaatggctatcttgggagacacagcttgggactttggatccatagggggagtgttcacgtcagtagggaaagcactacatcaagtttttggcgcgatctatggcgccgcctttagcggggtttcatggactatgaagatcctcataggggtggttacaacatggataggaatgaactcccgcagcacttccttgtcagtgaccctggtgttagtaggaatcgtgacactatacctgggagtgatggtgcaagcggacagtggttgcgtagtaagctggaagaacaaagaaatgaaatgtggaagtgggatctttgtaactgacaatgtgcacacctggacggaacaatacaaattccaaccagactccccttcaaagctggcttccgcaattcaaaaagctcatgaggaaggaatctgtggaatccgttcagtgacaaggttggaaaatctgatgtggaagcagataacaccagaattgaaccacatcctatccgaaaatgaagtcaaactgaccatcatgacaggagagattaaggggatcatgcaagcagggagaagatctttgaaacctcaacccactgagctgagatactcatggaaaacttggggaaaagcgaaagtactatcaacagaactccaaaatcaaactttcctcatagacggtcctgaaacaactgaatgccctagcagcaatagagcctggaactctttggaagttgaagattatggctttgggatttttaccaccaatatatggctaaagttgagagagaaacaagacacggtttgtgactcaaagttgatgtcagcagctgtcaaggacgacagggcagttcatgctgatatgggctattggatagagagcagactgaatgatacatggaagatggaaaaagcatcatttattgaggtcaaaagctgccactggccaagatcacacaccctttggagcaacggagtgctagagagtgaaatgataattccaaagaatctggctggaccagtctcgcagcataaccacagaccaggctattacacgcaaacagccggaccatggcacttgggcaaactcgagatggatttcgagttttgtgagggaaccacggtagtggtgaccgaggattgcggaaacagaggaccatccttgagaacaaccactgcctcaggaaaactcataactgagtggtgctgcagatcatgcacattaccaccactaagatacagaggagaggatggatgttggtacggaatggaaatcagaccactgaaagaaaaagaagagaacctggtgaactcattggttacagccggacatggccaaattgacaatttttcactagggattctaggaatggcattgctcttggaagagatgcttagaaccagagtaggaacgaagcacgccttgctgctagtggcgatctctttcgtgacactgattacagggaatatgtccttcaaggatctgggaagagtgataatcatggtgggagcagccatgacggacgagatgggtatgggcgtgacatacttggcattactagccgctttcagagtcagacctacctttgcagtggggttgctnttaagaaaacttacttcaaaggaattgttgatggcaaccatcggagttgtcctcctctctcagagtaacataccaggaacagttttggaactaactgacgcaatagcattgggaataatggttcttaaaatagtgaggagcatggaaaaataccagctagcagtgaccgtcatggctatgctatgtattccaaatgtcatgatactccagcatgcatggagagtgggctgcaccatattggcagcagtttctgtattaccactcctcttgacttcctcacaacaaaaaacggactggataccgttagcccttacaataaaaggtctcaatccgactgctattttcttaacaactctgtctagacccaataaaataagaagttggcctcttaatgaagctatcatggcagtcggaatggtgagcatactagctagttccctcctgaaaaatgacattccaatgacgggaccactggtggcaggaggacttctcacagtgtgctatgtgctcactggcagatcggcagacttggagctagaaaaagcggcagaggtgaaatgggaagatcaagctgagatatctgggagtagcccaatcctatcagttaccatatcagaagatggtagcatgtcaataaagaatgaggaagaagaacagactttaaccatactaataaggacaggactgttagtaatatcaggactattcccagtgtcaatcccaatcacagccgcggcttggtacctatgggagacaaaaaaacagagggccggagtgctatgggacgttccttcacctccaccaatgggaaaagctgagctagaagatggcgcttacagaatcaaacagagagggattttcggatactctcaaattggggctggagtgtacaaagaaggcacatttcacacgatgtggcacgtcacacgtggagctgtcctagtgcacaaagggaaaagaattgagccatcatgggcagacgtaaagaaagacttgatatcatatggaggaggctggaaactggaaggagagtggaaagaaggcgaagaagttcaggttttagcgctggaacctggaaaaaacccgagagcagtgcaaacaaaacccggactcttcaaaaccaacacaggaacaataggagccgtatccttagacttctccccaggaacgtcaggatccccaatcattgacaagaaaggaaaagtcgtgggtctctacggaaatggtgtcgtgacaaggagcggaacctatgtgagctccatagcccaaacagagaaaagcgtggaggacaatccagagattgaggatgatatatttcggaagaaaaggctaaccatcatggacttacatccaggagcgggaaaaacaaaacgatatctcccagccatagttagagaagcaataagaagaggcctgagaacactgattctggctcccaccagagtagtggctgcagaaatggaggaagccctacggggcctcccaatccgttaccagactccagccatcaaggcagagcacacagggcgcgaaatcgtggacctaatgtgtcatgccacattcaccatgaggttactatcaccaattagggtaccaaactacaacttaatcataatggatgaagcccatttcacagacccagctagcatagcagctcgaggatacatctccacccgtgtagaaatgggagaagctgctggaatatttatgacagccactcctccaggcagcagggacccttttccacagagcaatgccccaatagtggacgaggaaagagagattcccgagcgctcatggaattccggacatgaatggataacaaacttcaaaggtaaaacagtatggtttgtcccaagcataagagctggaaatgacatagcagcctgcttaaggaaaaatgggaaaagagtgatccagctaagtagaaagacctttgacacagaatacaccaaaacaagaacaaatgactgggacttcgtggtcacgactgacatttcggaaatgggggcaaacttcaaagctgaaagagtgatagatccaaggagatgcatgaagccagttatactgacagacggtgaagagcgcgtggttctggcaggacccatgccagtcacccactcaagtgcagcgcagagaagagggagaataggaaggaatcccaaaaatgagaacgaccaatatatttacatgggagaacctttagagaatgatgaagactgtgctcactggaaggaggcaaagatgctccttgataacatcaacacacctgaaggcatcatccccagcatgttcgagccagaacgtgagaaagttgatgccatagacggtgaataccggttaaggggggaagcaaggaaaacctttgtggatctgatgaaaagaggagacctaccagtctggctggcctacaaagtagcttcggaaggtataaactatgcagacaggaagtggtgctttgatggaatcagaaacaatcagatcctggaggagaacatggaagtggaagtttggacgaaagaaggtgagaggaaaaaattaaaacccagatggttggatgcaagaacttactcagatccgctagcactcaaagagttcaaggaattcgcggccggaaggaagtctctaaccttgagtttgatcacagaaatgggccggctcccaaccttcatgacccaaaaaacaagagatgccttggacaacttggctgtactgcactccgcagaaatgggtggaagagcctataaccatgctctcagtgaattgccagaaaccttagaaacactacttctgctaggtcttctggccacagtcacagggggaatctttctgttcttgatgagtggaagaggtgtagggaaaatgacccttggaatgtgttgcataatcacggccagcggccttctgtggtatgcacagatacagccccattggatagcagcttcaataatactagagttctttctcatagtactgttaatccctgaaccagagaagcaaagaacaccccaggacaatcagctgacctatgtggtcatagccattctgacattagtggcagccaccatggcaaacgaaatgggttttctagaaaagacaaagaaagaccttgggttgggaggcatcacaacgcaacagccagaaacaaatatcttggatatagacctccgacctgcatcagcgtggacactgtatgcagtggctaccacgtttgtcacgccaatgctgaggcatagtatagaaaactcttcagtgaatgtgtcactaacagctatagcaaaccaggccacggtgcttatgggcttgggaaaaggttggccactatcaaaaatggacataggagttcctcttctcgctattggatgttactcgcaggtgaatcccataaccctcacagcagcactactgctactaatggcacactatgccattataggccccggattacaagcaaaggccaccagagaggcgcagaaaagagcagcagccggcatcatgaagaatccaacagtagatgggattacagtgattgacctagaaccaataccctatgatccgaagtttgagaagcagttggggcaagtgatgcttttggtcctttgtgtgacacaggtgctgatgatgagaactacgtgggctctatgcgaagccctaaccctagcaacagggcccatatcaacactgtgggaaggaaacccagggaaattctggaacacaacaatagcagtctctatggctaacatttttagagggagttatttggctggagctggactcctcttttccatcatgaggaatacaaccagcgcacgaagaggaaccggcaccataggtgaaactttaggagaaaaatggaagagtcggctaaatgcactgggaagaagtgaattccagatatacaagaaaagtgggattcaggaggtagacagaaccctggcgaaggaaggcataaaaagaggagaaacagaccaccatgccgtttcacgaggctctgcaaagctgagatggtttgttgaaagaaacatggtcgccccagaaggaaaggtagtagaccttggttgtggcagaggaggatggtcgtattactgtggtggactaaaaaatgtgagagaagtcaaaggcctgacaaaaggaggaccaggacacgaagagcccatacccatgtcaacatatgggtggaatctagtgcgactgcagagtggagtggatgtattctttactccaccagagagatgcgacacactgctatgcgacataggagaatcgtcaccaaaccctacagtggaggccggacgaacactgagagttctcaatctagtggaaaattggctgggaagcaacacacagttttgcgtaaaagtcctcaatccttacatgccatcagtcatagagagaatggaaacattacagagaaagtttggaggcgctctagtccgcaatccactctcaaggaattcaacacatgagatgtactgggtgtccaacgcttctggaaatatcgtatcttctgtgaacatgatttcaaggatgttgataaatagattcacaatgaggcacaaaaaagccacctacgagcctgatgttgatcttggaagtggaacacgcaacattggaattgagtgtgaaacgccaaatatggacataattgggaaacggattgagaagataaaacaagaacatgaaacgtcatggcactatgaccaagatcatccatacaaaacatgggcataccacggcagttatgagacgaaacaaacaggatcagcatcatcaatggtaaacggagtggtcaggctgttaacaaaaccctgggatgtcattcccatggtgacgcaaatggcaatgacagacacaaccccctttggacagcagcgtgttttcaaggaaaaagttgacacaagaacccaggaaccaaaagagggcacgaaaaaattgatgagaatcacagcagagtggctttggggtgagttaggaaggagaaagaagcccagaatctgtacaagagcagagttctgcaacaaagtgagaagcaacgcagctctgggggcagtgttcaccgatgagaacaagtggaagtcagcacgcgaagcggtcgaagatgaaagattctgggagctggtggaaagagagagaaaccttcaccttgacggaaagtgtgaaacatgtgtgtacaacatgatgggaaaaagagagaagaaactgggagaatttggcaaagcaaaaggcagcagagccatatggtacatgtggctaggtgctcgctttttagaatttgaggccctaggttttttgaacgaggaccattggttctctagagaaaactctcttagtggagtggaaggagaaggactgcacaagctgggctacatcctaagagacatcagcaggaaagcaggaggagcaatctacgcagatgacactgctggttgggacacaaggatcacatctgaggatctgaagaatgaagaaatgataacaggccaaatggaagggagacataagaagctggcagaagccatattcaaactgacatatcagaataaggtagttcgcgttcaaaggccaaccccaagaggcacggtgatggatatcatttcaaggagagatcaaagaggcagtgggcaggtggggacgtatggtctcaacaccttcaccaatatggaagcacaactgataaggcagatggaaggggaaggactcttcaagagcatcctacatttaacaccccaagaggaaattgctgtccacacttggctagttagagagggacgcgaacgcctcgcaagaatggcaatcagtggagatgactgcgtcgtgaaaccactagatgatagattcgccagagctttaacagcattgaatgacatgggaaaagtgaggaaagatatacaacagtgggaaccctcaaaaggatggagtgattggacccaagtgcccttttgctctcaccactttcatgaactaataatgaaagatggtcgcaagcttgtagtcccatgcagaagccaggatgaactgataggcagagcgcgtatctcccagggggcaggatggtccttgagagagacagcctgtttggggaagtcatatgcccagatgtggagcctgatgtatttccacaggcgtgatctcaggctggctgctaatgccatctgttcagcagttccatcacattgggttccaaccagcaggacgacttggtccatacatgctagtcatgaatggatgacgacggaagacatgttagcagtttggaacagggtgtggatccaggacaatccatggatggaagacaagacccccgtagaatcatgggaagacataccatacctagggaaaagggaagaccagtggtgtggttccttgattggcttaacaagcagggccacctgggcaaggaacattcagacagccataaaccaagtcagagccctcattggtgaggaggaatacacggactacatgccctcaatgaaaaggttcaggagtgaagaggaggagtcaggagtcctgtggtaa

SEQ ID NO: 742 - DNA, 10176 bp, Dengue virus
atgaataaccaacggaaaaaggcgagaaatacgcctttcaatatgctgaaacgcgagagaaaccgcgtgtcaacgattcaacagttgacgaagagattctcacttggaatgctacaagggaaagggccattaaagttgtttatggccctagtggctttcctccgtttcctaaccatcccaccaacagcagggatattgaagagatggggaacgatcaaaaagtcaaaagccatcagtgtgttaagaggattcagaaaggaaatcgggagaatgctgaacatactgaacagaagacgcagaacaacaggtcttctcatcatgattatcccaacagtgatggcattccacctgactacacgcaacggggagccacacatgattgtcagcaagcatgagaaaggaaagagcctcctcttcaaaacagaggatggaatgaacatgtgcaccctcatggccatggatctgggcgagttgtgtgaagacaccattacatacaagtgtccttttctcaagcaaaacgagccagaagatatagactgctggtgcaatgccacatcaacctgggtgacctatgggacatgtagcacaacgggagaacacaggagggagaaaagatcggtagcacttgtcccacatgtgggaatgggattggaaacaagaactgaaacgtggatgtcatcagaaggagcatggaaacaggcccaacgaattgagacatggattctgaggcacccaggcttcaccctcatggcagcaattttagcgtacacaatagggacaacacacttccaaaaaatcctgatcttcatcctattgactgctgttgctccctcgatgacaatgcgctgcataggcatatcaaacagagactttgtggagggagtttcaggaggaagctgggttgacatcgtcctagaacatggaagctgtgtcacaacaatggcaaagaacaaaccaacactagactttgagctgataaagacagaagcaaaacaaccagcaacacttaggaaattctgcattgaagccaaattaaccaacacgacaacggaatctcgttgcccaacccaaggtgaacccagcttagtggaggagcaagacaaaaggttcgtctgcaaacactcgatggtggatagaggttgggggaatggatgtggtctgttcgggaaaggaggtgttgtgacctgtgcgatgttcacatgcttgaagaacatggaagggaaagttgtgcaaccagaaaatttagaatacaccatagtcataacacctcactcaggggaggaacatgctgtagggaatgatacaggcaagcatggtaaggaggtcaagataacgccccaaagttccatcactgaagctgaactgactggctatggcacgattacaatggagtgctctccacgaacaggcctagactttaatgagatggtcctgctgcaaatggagaaaaaagcatggttagtacacagacagtggttcttggacttacctttaccatggcttcctggagctgacacgcaagggtctaactggatccaaaaagagatgctggtaacattcaaaaatccccatgcaaagaaacaggacgttgtcgtcctggggtcccaagaaggcgccatgcatacagcacttacaggagccacagaaatacaaatgtcatcaggaaatttactattcacaggacatttgaagtgcaggttgagaatggacaagctgcaactcaaaggaatgtcatattctatgtgcacagggaagttcaaagttgtaaaagaaatagctgagacgcagcatggaacaatagtcattagagtgcagtatgaaggagaaggtgcaccatgcaagattccctttgagatcatggacttggaaaagaagcacgtcttagggcgactaattacggtcaatccaatagtaacagagaaagacagcccaatcaacatagaagcagaacctccatttggtgacagctatatcgttataggagtagaaccaggacagttgaaactcaattggttcaaaaaagggagctccataggacaaatgtttgaaacaacaatgagaggagccaaaagaatggccatcttgggagacacagcttgggattttggatctctagggggagtgttcacgtctgtagggaaggcgctgcatcaggtatttggtgcaatctatggtgttgcttttagcggggtctcgtggaccatgaagatcctcataggggtgattataacatggatagggatgaattctcgcagcacctccctgtcagtgacacttgtgattgtaggaattgtaacactctacttaggagtgatggtgcaggcggatagtggctgtgttgtgagctggaagaacaaagaactgaaatgtggaagtgggattttcgtgactgacaatgtgcacacctggacggagcaatataaattccaaccagactccccttcaaagttagcttctgccatccaaaaagcccacgaagagggaatctgcgggattcgttcagtaacaaggctggagaacttaatgtggaagcaaataacaccagaattgaatcacatcctatatgaaaatgaagtcaaactaactatcatgacaggagacatcaaaggaattatgcaggcagggaaaagatctttaaaaccccaacccattgagttgaaatactcatggaaatcctgggggaaagcaaaagtactttcaacagagctccagaatcaaaccttcctcatagacggtcctgaaacaacagaatgccctaacagcaatagggcctggaattcactggaagttgaggattatggttttgggatcttcactaccaatatatggctcaagctaaaagaaaagcaagacacgttttgtgactcaaaattgatgtcagctgccgtcaaggacaatagagcagttcatgctgatatgggttattggatagagagcaggttaaatgacacatggaaaatggaaaaagcgtctttcattgaagttaaaagctgctactggccaagatcacacactctctggagtaatggagtcctagagagtgaaatgataataccaaagaacctggccggaccagtatcacagcacaattacaggcctggctactacacacaaaccgccggaccatggcacttgggcagacttgagttggatttcgaactttgtgagggtaccacggtagtggtgaccgaagactgtggaaatagaggaccatccttgagaacaactactgcctcaggaaaactcataactgagtggtgctgtagatcatgcacattgccaccactaaggtacagaggagacgatggatgctggtacggaatggagatcagacctttgagagagaaggaagaaaacctggtgaactcattggtcacagccggacatggacagattgacaacttttcactagggattctgggaatggcactgttcctggaagagatgctcagaaccagaatggggacaaaacatgctctattgttggtagcgatttccttcgtgacactgatcaccggcaatctgtccttcaaggatctcggaagagtgatagttatggtaggagctgctatgacggatgaaatgggcatgggagtgacgtatctggcactgctagccgcctttaaagttaggcccaccttcgcagcagggttgctcctgaggaaactcacttcaaaagagttgatgatgacgaccataggagtcgttctcctctcccagagcaacatgccagaaacagttctggagctaaccgacgcaatagcattgggaataatggtccttaaaatggtgaggagcatggaaaagtaccagttgtcagtgaccattatggccatgctgtgcattccaaacgccacaatactccaacatgcatggaaagtgagctgtgctatactagcagcagtttcagcatcaccactgcttttaacttcctcacaccaaaagacggactggataccgttagcactcacaataaaaggtctcaacccaactgctatctttctgacaactttatccagacccaacaaaacaaggagttggcctctcaacgaagccatcatggcagtaggaatggtgagcattctggccagttctcttttaaagaatgacatcccaatgacaggaccattggtggcaggaggacttctcacagtgtgttatgtgctcactggcaggtcggcggacttggagctggaaaaggcggcagaggtgaaatgggaggatcaagctgagatatcaggaagcagtccaatcctatcagtcactatatcagaggatggtagcatgtcaataaagaatgaggaggaagaacaaaccttgactatactgattaggacggggttactagtgatatcaggactattcccggtatcaatcccaatcacagctgcagcttggtacctatgggagacaaaaaagcagagggccggagtgctgtgggatgttccttctcctccacccgtggaaagggctgagttagaggatggcgcctatagaatcaaacagagagggatattcggatactcccaaataggtgctggagtgtacaaggaaggtacattccacacgatgtggcacgtcacacgtggggctgtcttaatgcacaaaggaaaaagaattgagccatcatgggcggatgtgaggaaagacctgatatcatatggaggaggttggaaactggaaggagaatggaaagaaggcgaagaagtccaagtcctggcgctggaaccggggaagaatccgagagcggtgcaaacaatacccggtctcttcaaaactaacacaggaacaataggagccgtatccttggacttctccccaggaacatcaggttccccaatcattgacaagaaaggaaaggtagtgggtctctatggaaatggtgttgtgacaagaagtggaacttacgtgagttccatagcccaaacagagaaaagcatggaagacaacccagaaattgaggacgacatattccgaaagaaaaggttaaccattatggacttacatccaggggctggaaagacaaaacgatacctcccagctatagttagagaagcaataagaagaggcctgagaacactgatcctagcccctaccagggtagtggctgcagaaatggaggaagccttacgggggctccctattcgttatcaaaccccagctatcaaagcagaacacacaggacgtgaaattgtggacttaatgtgccatgccacgtttaccatgaggttactatcaccggtcagggtaccaaattacaacttgatcataatggatgaagctcattttacagacccagccagcatagcagcccgaggatacatatccacccgggtggaaatgggagaagccgctggaatatttatgacagccacccctccaggcagcagagacccgtttccacagagtaacgccccaataatggatgaggaaagagaaattcccgagcgctcatggaattccgggcacgaatggataacaaattttgaagggaaaacagtgtggtttgttccaagcataagagctggaaatgacatagcagcctgcttaaggaaaaacgggaaaagagttatccagctcagcagaaagacctttgactcagaatatgttaaaacgagaacaaatgactgggacttcgtagtcacaactgacatttcagaaatgggagcaaacttcagagcggaaagagtgatagacccaagaagatgcatgaagccagttatactgacggatggtgaagagcgagtgatcttagcaggacctatgccagtaacccactcaagtgcagcacaaagaagagggagaataggcagaaatccaaaaaacgagaatgaccaatacatctacatgggggaacccctggagaatgacgaggactgcgcccactggaaggaagcaaagatgctccttgacaacatcaatacacctgaaggcatcatccccagcatgtttgaaccagaacgtgagaaagtagacgccatagacggggagtataggttaagaggggaagcaaggaaaaccttcgtggatttgatgagaagaggagatctaccagtttggttagcttacaaagtagcttctgaaggaataaactatgcggataggaggtggtgctttgatggaatcagaaacaatcagatcctggaggagaacatggaagtggaggtttggacgaaagaaggcgagagaaaaaagttgaaacctagatggctggacgcaaggacttattcagatccattagcactcaaagagttcaaagagttcgcagccggaagaaaatctttaaccctgagcctgatcacagaggtgggacggctcccaactttcatgacccagaagactagggatgccttggacaacttggcagtgttgcacactgcagaaacgggaggaagagcttataaccacgctcttagtgaattacctgaaaccctggaaacattactcctgttaggccttttagccacagtcacagggggaatttttctgttcctaatgagtggaagaggcgtgggaaaaatgaccctgggaatgtgctgcataatcacagcaagcggcctcctgtggtacgcacagatacagcctcattggatagcagcctcaataatactagagttttttctcatagtactgctcatccccgagccagagaagcaaagaacgcctcaggataatcaattgacctatgtgatcatagccattttgacactagtggcagcgaccatggcaaatgaaatgggcttcctagaaaagacaaagagagaccttgggttgggaggtggtacaacacaacaactagaggcaaacattctggacatagatcttcgacctgcatcagcgtggacactatacgcagtggccaccacgttcatcacaccaatgttgaggcacagtatagaaaactcttcagtgaatgtatcactaactgccatagccaaccaggccacggtgttgatgggcctaggaaaaggctggccattatcaaaaatggacataggagtccctcttcttgccattggatgctattcacaggtgaatcccataaccctcacagcagcgttgctgctgttagtggcacactatgccattataggtcccggactccaagcaaaagccaccagggaggcacaaaaaagagcagcagctggtatcatgaagaacccaacggtggatggaataacagtaattgatctggaaccaattccttacgatcctaaatttgaaaagcagttaggacaagtgatgcttctggttctatgtgtgacacaggtgctgatgatgagaacaacgtgggccctgtgtgaagccttaactctagcaactggacccatatcaacactatgggaagggaaccctggaaaattctggaacacaacaatagcagtctccatggccaatatattcaggggaagctacttagccggagccggacttcttttttccatcatgaagaatacaaccagcgcacggagaggaactggcaccacaggtgagactctaggagaaaaatggaagagccgacttaacgcactgggaagaagtgaatttcaaatatataaaaaaagtgggattcaagaagtggacaggaccttagccaaagaaggtataaaaaggggagaaactgatcaccacgccgtttcacggggttccgcaaagctgagatggttcgtcgaaagaaatatggtagccccagaaggaaaagtggtagatctcggttgtggcaggggaggatggtcatatttctgtggtggacttaaaaatgtgaaagaagtcaaaggtctgacgaaaggaggaccagggcatgaagaacccataccaatgtcaacgtatgggtggaacctagtgcggctccagagtggagtggatgttttcttcaccccaccggagagatgtgacacactgctgtgcgatataggggaatcatcaccaaaccccacagtagaggccggacggacactgagagttcttaatctggtggaaaattggctaggcagcaatacccagttctgcgtgaaagtcctcaacccctacatgccatcagttatagagagaatggaggcattgcaaaggaaatttggaggcgccctagtgcgcaacccactctcgcggaattccacgcatgaaatgtactgggtgtcaaatgcctccgggaacattgtgtcttccgtgaacacaatctcaagaatgttgctaaacagatttacgatgagacacaaaaaagccacctatgagcccgacgttgatcttgggagtggaacacgcaacattggaatagaatgtgaagtgccgaatatggatgtaattggaaaacggattgaaaaaataaaacaagaacatgaaacgtcatggcactatgaccaagatcatccatacaaaacatgggcataccacggcagttacgagacgaaacagacagggtcagcctcatcaatggtgaatggagtggtcagactgctaaccaaaccctgggacgtcattcccatggtcacacaaatggcaatgacagacacaaccccctttggacagcagcgcgtgttcaaagaaaaagttgacacgagaacccaagaaccaaaggagggtacgaaaaaattaatgagaatcacagcggagtggctttggaacgaactggggaggaaaaagaaacctaggatctgtacaagagctgaattttgcaataaagtgagaagcaatgcagctctgggggctgtgttcactgatgaaaacaagtggaagtcagcacgtgaagctgttgaagatgaaagattctgggagctggtggagagagaaagaaaccttcacctcgaaggaaaatgtgagacatgtgtgtacaatatgatgggaaagagagagaaaaagttaggggaattcggcaaggcaaaaggcagcagagccatatggtacatgtggctgggagcccgtttcctagagtttgaagccctaggcttcttaaatgaagaccactggttctccagagaaaattcactaagtggagtagagggagaaggattgcacaagctggggtacatcctaagagacatcagcagaaaagaaggaggagcgatgtatgcagacgacaccgctggctgggacacgagaattacatctgaagacttgaagaatgaggaaaagataacaaaccagatggaaggaaaacacaagaagttggcagaggccattttcaaactaacataccagaacaaagtggttcgtgtccaaagaccaaccccaagaggcacagtgatggacatcatctcaagaagagatcaaagaggtagtgggcaagtgggaacgtatggcctcaacacctttactaacatggaagcacaactgattaggcagatggaaggagaaggactgttcaaaagcatccagcacctgacatcccaagaagaaatcgctgtgcacgcctggctggctagagaagggcgtgagcgcctcacaagaatggccatcagcggggatgattgtgtcgtgaaaccactagatgacaggttcgccaaggccctagtagcattgaatgacatgggaaaggtgaggaaagatatacaacagtgggagccctcaaaagggtggaatgactggactcaagtacccttctgctctcaccatttccatgaactgataatgaaagatggtcgcactctcgtagtcccatgcagaagtcaagatgaattgattggcagagcgcgaatctcccagggggcaggatggtccttaagagagacagcatgcttaggaaagtcatacgcccaaatgtggagtttgatgtacttccatcgacgtgatctcaggctggctgccaacgccatttgttcagcagttccatcacactgggttccaaccagcaggaccacttggtccatacatgccacccatgaatggatgacaactgaagacatgttggcggtctggaatagggtgtggatccaagacaacccatggatggaagacaagacttttgtggaatcatgggaggacataccgtacctaggaaaaagagaagaccagtggtgtggctccttgattggcttgacaagtagagccacttgggcaaagaacatacaaacagccataaatcaagttagagctcttattggtgaagaggaatacacagactacatgccttcaatgaagagatttaggagagaagaagaggaggcaggagttctgtggtag

SEQ ID NO: 743 - DNA, 10176 bp, Dengue virus
atgaataaccaacggaaaaaggcgagaaacacgcctttcaatatgctgaaacgcgagagaaaccgcgtgtcaactatacaacagttgacgaagagattctcacttggaatgctgcaagggagagggccactaaagctatttatggccctagtggcgttccttcgtttcctaaccatcccaccaacagcagggatactgaagagatggggaacgatcaaaaaatcaaaggctgtcagtgtactgagaggatttagaaaggaaattgggaggatgctgaacattttgaacaggagacgcagaacagcgggcttcctcatcatggtcattccaacagtggtggcttttcatttgactacacgcaatggggagccacacatgattgtcagcaagaatgagaaaggaaagagcctcctttttaaaacagagaatggaataaacatgtgcacccttatggccatggatttaggcgagttgtgcgaggacaccgtcacatacaagtgtccctttctcaagcaaaacgagccggaggacatagactgctggtgcaattccacatcaacctgggtgacgtacgggacgtgcagctcgacaggagagcataggagggagaaaaggtcagtcgcacttgtcccacacgtaggaatggggctggaaacgagaactgaaacatggatgtcatcagaaggagcatggaaacaagcccagcggattgagacatggattctgaggcacccaggcttcactcttatggcagctgttttggcatacacaatagggacaacacatttccaaagagccctaatctttatccttttaactgccgttgctccctcaatgacaatgcgatgtataggcatatcgaaccgagacttcgtagagggagtttcaggaggaagctgggttgatattgtcttagaacatggaagctgcgtcacaacaatggccaagaacaaaccaacattagactttgaactaataaaaacagaggccaagcaaccagcaacattgagaaaattctgcattgaagccaaattgaccaacacaacaacagaatcccgctgcccaacccaaggtgaacccagtctagtagaggagcaggacaaaagattcgtttgcagacattcgatggtggatagaggttggggtaatggatgtggtctgtttgggaaaggaggcattgtgacctgtgcgatgttcacatgcttgaagaaaatggagggaaaagttgtgcagccagaaaacctagagtacaccatagtcataacaccccattcaggagaggaacatgctgtggggaatgatacagggaagcacggcaaggaggttaaaataacaccccaaagctctattgctgaagctgaactgacaggttatggcacgatcacgatggaatgctccccacgaacaggtctcgattttaacgagatggtcctgctgcagatggagagcaaagcttggctagtccatagacagtggtttctggacttacctctaccatggcttcctggagcagacacacaagggtccaattggatccagaaagagatgctagtaacattcaaaaatccccatgcgaaaagacaagacgttgtcgtcttgggttcgcaagagggcgccatgcacacagcactcacaggagcaacagaaattcaaatgtcattaggaaacatactatttatggggcatttgaagtgtagactgaggatggacaagctgcaactcaaagggatgtcgtactctatgtgcacaggaaagttcaaagttgtcaaagagatagcggaaacacaacatggaacaatagtcatcagagtgcagtatgaaggagatgactcaccatgcaagatcccttttgagatcatggacttggaaaagaaacatgttttagggcgattgatcacggtcaacccaatagtgacagagaaagacagtccaatcaacatagaagcagaacctccatttggtgatagctacattatcataggagtggagccaggacagctgaaattaaactggtttaaaaaaggaagctctataggacaaatgtttgaaacaacaatgagaggagctaaaagaatggccatcttgggagacacagcttgggactttggatctatagggggagtgttcacatcagtagggaaagcactacatcaagtttttggcgcaatctatggcgccgcctttagcggggtttcatggactatgaagatcctcataggggtggttataacatggataggaatgaattcccgcagcacttccttgtcagtgaccctggtgttagtaggaatcgtgacactatacctgggagtgatggtgcaagcggacagcggttgtgttgtaagctggaagaacaaagaactgaaatgtggaagtgggatctttgtaactgacaatgtgcacacttggacggaacaatacaaatttcaaccagactccccttcaaagctggcttccgcaattcaaaaagctcatgaggaaggaatctgtggaatccgttcagtgacaaggttggaaaatctgatgtggaagcagataacaccagaattgaaccacatcctatccgaaaatgaagtcaaactgaccatcatgacaggagagattaaggggattatgcaagcagggagaagatctttgaaaccccaacctactgagctgagatactcatggaaaacttggggaaaggcgaaggtactatcaacagaactccaaaatcaaactttcctcatagacggtcctgaaacaactgaatgccctaatagcaatagggcctggaactctttggaagttgaggattatggttttgggatttttaccactaatatatggctaaagttgagagagaaacaagacatgatttgtgattcaaagttgatgtcagcagctgttaaggacgacagagcagttcatgctgatatgggctattggatagagagcagactgaatgacacatggaagatggaaaaagcatcatttattgaggttaaaagctgctactggccaagatcacacaccctttggagcaacggagtgctggagagcgaaatgataattccaaagaatctggctggaccagtgtcgcagcacaactacagaccaggctattacacgcaaacagctggaccatggcatttgggcaaactcgagatggatttcgagttttgtgaaggaaccacggtagtggtgaccgaggattgcggaaacagaggaccatccttgagaacaactaccgcctcaggaaaacttataactgagtggtgctgcagatcatgtacattaccaccactaagatacagaggagaggatggatgttggtacggaatggaaattagaccactgaaagaaagagaagagaacctggtgaactcattggttacagccggacatggccaaattgacaatttttcactagggattctgggaatggcattgctcttggaagagatgcttagaaccagagtaggaacaaagcacgccttgctcctagtggcgatctctttcgtgacactgattacagggaatatgtccttcaaggatctaggaagagtaataattatggtgggagcagccatgacggacgagatgggtatgggcgtgacatacttggcattactagctgctttcagagtcagacctacctttgcagtggggttgcttttgagaaaacttacttcaaaggaattgttgatggcaaccatcggagtcgttctcctctctcagagtaacataccaggaacagttttggaactaactgacgcaatagcattaggaataatggttcttaaaatagtgaggagcatggaaaaataccagctagcagtgaccgtcatggccatgctatgtattccaaatgtcatgatactccagcatgcatggaaagtgggctgcaccatattggcagcagtttctgtatcaccactcctcttgacttcctcacaacaaaaaacggactggataccgttagtcctcacaataaaaggtctcaatccgactgctatcttcttaacaactttgtctagacccaataaaacaagaagttggcctctcaatgaagctatcatggcagttggaatggtgagcatactagctagttcccttctgaaaaatgacattccaatgacgggaccactggtggcaggaggacttctcacagtgtgctatgtgcttactggcagatcggcagacttggagctagagaaagccgcagaggtgaaatgggaagatcaagctgagatatctgggagtagcccaatcctatcagtcactatatcagaagatggtagtatgtcaataaagaatgaggaagaagaacagaccttaactatactgataaggacgggactgttagtaatatcaggactattcccagtatcaatcccaatcacagctgcggcctggtacctatgggagacaaaaaagcagagggccggagtgctgtgggacgttccttcacctccaccaatggaaaaagctgagctagaagatggcgcttacagaatcaaacagagagggattttcggatactctcaaattggggctggagtgtataaagaaggcacatttcacacgatgtggcacgtcacacgtggagctgtcctagtgcacaaagggaaaaggattgagccatcatgggcagacgtgaagaaagacttgatatcatatggaggaggctggaaactggaaggagagtggaaagaaggcgaagaagttcaggttttggcgctggaacctggaaaaaacccgagagcagtgcaaacaaaacccggcctcttcaaaaccaacacaggaacaataggagccgtatccttagacttctccccaggaacatcaggatccccaatcattgacaagaaaggaaaagtcgtgggtctctacggaaatggtgtcgtgacaagaagcggaacctatgtgagctccatagcccaaacagagaaaagcgtggaggacaatccagagattgaagatgatatatttcggaagaaaaggctaaccatcatggacttacatccaggagcgggaaaaacaaaacgatatctcccagccatagttagagaagcaataagaagaggcctgagaacactgattctggcccccaccagagtagtggctgcagaaatggaggaagccctacgggggctcccaatccgctatcagactccagccatcaaggcagagcacacagggcgcgaaatcgtagacctaatgtgtcatgccacattcaccatgaggttactgtcaccaatcagggtaccaaactacaacttaatcataatggatgaagcccatttcacagacccagctagcatagcagctcgaggatacatctccacccgagtagaaatgggagaagctgctggaatatttatgacagccactcctccaggcagcagggacccttttccacagagcaacgccccaatagtggacgaggaaagagagattcccgaacgctcatggaattccggacacgaatggataacaaactttaaaggcaaaacagtatggtttgtcccgagcataagagctggaaacgacatagcagcctgtttgaggaaaaatggaaaaagagtgatccagctaagtaggaaaacctttgacacagaatacatcaaaacaagaacaaatgactgggacttcgtagtcacgactgacatctcagaaatgggggcaaacttcaaagctgaaagagtgatagatccaaggagatgtatgaagccagttatactgacagatggtgaagaacgtgtggttctggcaggacccatgccagtcactcactcaagtgcagcacagagaagagggagaataggaaggaatccaagaaatgagaacgaccaatatatttatatgggagaacctttagagaatgatgaagactgtgctcattggaaggaggcaaagatgctccttgataacatcaacacacctgaaggtatcatccccagcatgttcgagccagaacgtgagaaagttgatgccatagacggtgaataccggctaaggggggaagcaaggaagacttttgtggacctgatgaaaagaggagacctaccagtttggctggcttacaaagtagcttcggaaggcataagctatgcagacaggaagtggtgctttgatggaatcagaaataatcagatcctggaggagaatatggaagtggaagtttggacgaaagaaggtgagaggaaaaaactaaaacccagatggttggatgcaagaacttactcagatccgctagcactcaaagagttcaaggaatttgcggccggaaggaagtctctaactctgagtttgatcacagaaatgggtcggctcccaaccttcatgacccaaaagacaagagatgctctggacaacttggctgtactgcactctgcagaaatgggtggaagagcctataaccatgctctcagtgaattgccagaaactttagaaacattgctcctgctaggtcttttggccacagtcacagggggaatctttttgttcttgatgagtggaagaggtgtagggaaaatgaccctcggaatgtgttgcataatcacggccagcggccttctgtggtatgcacagatacagccccattggattgcagcttcaataatactagagttctttctcatagtactgctaatccctgaaccagagaagcaaagaacaccccaggacaaccagttgacctatgtggtcatagccatcctgacactagtggcagccaccatggcaaacgaaatgggttttctagaaaagacaaagaaagaccttgggttgggaggcattacaatgcaacaaccagaaataaatatcttggacatagacctccgacctgcatcagcgtggacactatatgcagtggctactacgtttgtcacgccaatgctgaggcacagcatagaaaactcctcagtgaatgtgtcactaacagctatagcaaatcaggccacggtgctaatgggcttgggaaaaggttggccactatcaaaaatggacataggagttcctcttcttgccattggatgctactcgcaggtgaatcccataaccctcacagcagcactactgctattagtggcacactatgccatcataggccctggactccaagcaaaggctaccagagaggcgcagaaaagagcagcagctggcatcatgaagaatccaacagtagatgggattacagtgattgacctagaaccaataccctatgatccgaagtttgagaagcagttagggcaagtgatgctcttggtcctttgtgtgacacaggtgctgatgatgagaaccacgtgggctctatgcgaagccctaaccctagcaacagggcccatatcaacactgtgggaaggaaatccagggaaattctggaacacaacaatagcagtctctatggctaacattttcagagggagttatttggctggagccggactccttttttccatcatgaggaacacaaccagcgcacgaagaggaaccggtaccataggtgaaactttaggagaaaaatggaagagccggctaaatgcactgggaagaagtgaattccagatatacaagaaaagtgggattcaggaggtagacagaaccctggcgaaggaaggcataaaaagaggagaaacagaccaccatgccgtttcacggggctctgcaaagctgagatggtttgttgaaagaaacatggtcgccccagaaggaaaggtagtagaccttggttgtggcagaggaggatggtcatattactgtggtggactaaaaaatgtgagagaagtcaaaggcctgacgaaaggaggaccaggacatgaggagcctatacctatgtcaacatacgggtggaatctagtgcgactacagagtggagtggatgtattctttactccaccagagagatgcgacacactgctatgcgacataggagaatcgtcaccaaaccccacagtggaggccggacgaacactgagagttctcaatctagtagaaaattggctgggaagcaacacacagttttgcgtaaaagtcctcaacccttacatgccatcagtcatagagagaatggaagcactacagagaaagtttggaggcgctctagtccgcaatccactctcaaggaattccacgcatgagatgtactgggtgtccaacgcttctggaaatattgtatcttctgtgaacatgatttcaaggatgttgataaatagattcacaatgaggcacaagaaagccacctacgagcctgatgttgatcttggaagtggaacacgcaacattggaattgagtgtgaaacgccaaatatggacataattggaaaacggattgagaaaataaaacaagaacatgaaacgtcatggcactatgaccaagatcatccatacaaaacatgggcataccacggcagttatgagacgaaacaaacaggatcagcatcatcaatggtaaacggagtggtcaggctgttgaccaaaccctgggatgtcattcccatggtgacgcaaatggcaatgacagacacaaccccctttggacagcagcgtgttttcaaggaaaaagtagatacaagaacccaggaaccaaaagaaggcacgaaaaaattgatgagaatcacagcaaagtggctttggggtgagttaggaagaagaaagaagcccagaatctgcacaagagcagagttctgtaataaagtgagaagcaacgcagctctgggggctgtgttcactgatgagaacaagtggaagtcagcacgcgaagcggtcgaagatgaaagattttgggaactggtggaaaaagagagaaaccttcaccttgacggaaagtgtgaaacatgtgtgtacaacatgatgggaaaaagagagaagaaactgggagaatttggcaaagcaaaaggcagcagagccatatggtacatgtggctaggtgcccgctttttggagtttgaggccctaggttttttgaacgaagaccattggttctctagagaaaactctctaagtggagtggaaggagaaggactgcacaagctgggctacatcctaagagacattagcagaaaagcaggaggagcaatgtacgcagatgacactgctggttgggacacaaggatcacatctgaggatctgaagaatgaagaaatgataacagatcaaatggaagggagacataagaagctggcagaggccatattcaaactaacataccagaataaggtagttcgcgtccaaagaccaaccccaagaggcacggtgatggatatcatttcaaggagagaccaaagaggcagtgggcaggtggggacgtacggtctcaataccttcaccaatatggaagcacaactgataaggcagatggaaggggaaggactctttaagagcatactgcatttaacaccccaagaggaaactgctgtccacgcttggctggttagagagggacgcgaacgcctcgcaagaatggcaatcagtggagatgactgcgtcgtgaaaccactagatgacagattcgccagagctttaacagcattgaatgacatgggaaaagtgaggaaagacatacaacagtgggaaccttcaaaaggatggagtgattggacccaagtgcccttttgctctcaccactttcatgagctaataatgaaagatggtcgcaagcttgtagtcccatgcagaaaccaggatgaactgataggcagggcgcgcatctcccagggggcaggatggtccttgagagagacagcctgtttggggaagtcatatgcccagatgtggagcctgatgtacttccacaggcgtgatctcaggttggctgctaacgccatatgttcagcagttccatcacattgggttccaactagcaggacaacttggtccatacatgctagtcatgaatggatgacgacggaagacatgttagcagtctggaacagggtgtggatccaggacaatccatggatggaagacaagacccccgtggaatcgtgggaagacataccatacctaggaaaaagggaggaccagtggtgtggttccctgattggcttaacaagcagggccacctgggcaaagaacattcaaacggccataaaccaagtcagagctctcattggtgaggaggaatacacggactacatgccctcaatgaaaaggttcaggagtgaagaggaggagtcaggagtcctgtggtaa

SEQ ID NO: 744 - DNA, 10176 bp, Dengue virus
atgaataaccaacggaaaaaggcgagaaacacgcctttcaatatgctgaaacgcgagagaaaccgcgtgtcaacaatacaacagttgacgaagagattctcacttggaatgctacaagggagagggccactaaagctatttatggccctagtagcgttcctccgtttcctaaccatcccaccaacagcagggatattgaagagatggggaacgatcaaaaaatcaaaggctatcagtgtactgagaggatttagaaaggaaattgggaggatgctgaacattttgaacaggagacgcagaacagcgggcttcctcatcatggttattccaacagtgatggcttttcatttgaccacacgcaacggggagccacatatgattgtcagcaagaatgagaaaggaaagagcctcctttttaaaacagagaatggaataaacatgtgcacccttatggccatggatctaggcgagttgtgcgaggacaccatcacatataagtgtccctttctcaagcaaaacgagccagaggatatagactgctggtgcaactccacatcaacctgggtgacgtacgggacatgtagctcgacaggagagcataggagggagaaaagatcagtcgcacttgtcccacatgtaggaatggggttggaaacgagaactgaaacatggatgtcatcagaaggagcatggaaacaagctcagcggattgagacatggattttgaggcacccaggtttcactcttatggcagctgttttggcgtatacaatagggacaacacatttccaaagagccctaatctttatccttttaactgccgttgctccctcaatgacaatgcgatgtataggcatatcaaaccgagactttgtggagggagtttcaggaggaagctgggttgatatcgtcttggaacatggaagctgcgtcacaacaatggccaagaacaaaccaacattggactttgaactaataaaaacagaggccaagcaaccagcaacattgagaaaattctgcatagaagccaaattgaccaacacaacaacggaatcccgctgcccaacccaaggtgaacccagcctagcagaggagcaggacaaaagattcgtttgcaggcattcgatggtggatagaggttggggtaatggatgtggtctgtttgggaaaggaggtattgtgacctgtgcgatgttcacatgcttgaagaaaatggagggaaaagttgtgcagccagaaaacctagagtacaccatagtcataacaccccattcaggagaggaacatgctgtggggaatgacacagggaagcacggcaaggaggttaagataacgcctcaaagctctattgccgaagctgaactgacagattatggcacgatcacgatggaatgttccccacgaacaggtctcgatttcgatgagatggtcctgctgcaaatggagaacaaagcatggctagttcatagacagtggtttctggacttacctctaccatggcttcctggagcagatacacaagagtctaattggatccagaaagagatgctagtaacattcaaaaacccccacgcgaaaagacaagacgttgtcgtcttgggatcgcaagagggcgccatgcacacagcactcacaggagcaacagaaattcaaatgtcatcgggaaatatactatttgtggggcacttgaagtgcagactgaggatggacaagctgcaactcaaagggatgtcatactccatgtgcacaggaaagttcaaagttgtcaaagagatagcggaaacacaacatggaacagtagtcatcagagtgcagtatgaaggagatgactcaccatgcaagattccttttgagatcatggacttggaaaagaaacatgttttagggcgactgattacggtcaacccaatagtaatagagaaagacagcccaatcaacatagaagcggaacctccatttggtgatagctacattgtcataggagtggagccaggacagctgaaattaaactggttcaaaaaaggaagctctataggacaaatgtttgaaacaacaatgagaggagctaaaagaatggccatcttgggagacacagcttgggactttggatccatagggggagtgttcacatcagtagggaaagcactacatcaagttttcggcgcgatctatggcgccgccctcagcggggtttcatggactatgaagatcctcataggggtggttataacatggataggaatgaactcccgcagcacctccttgtcagtgaccctggtgctagtaggaatcgtgacactatacctgggagtgatggtgcaagcggatagtggttgcgttgtaagctggaagaataaagaactgaaatgtggaagtgggatctttgtaaccgacaatgtgcacacctggacggaacaatacaaatttcaaccagactccccttcaaagctggcttccgcaattcaaaaagctcacgaggaaggaatctgtggaatccgttcagtgacaaggctggaaaatctgatgtggaagcagataacaccagaattgaaccacatcctatccgaaaatgaagttaaactgaccatcatgacaggagagattaaggggatcatgcaagcagggagaagatctttgaaacctcaacccactgaactaagatactcatggaaaacctggggaaaagcgaaagtactatcaacagaactccaaaatcagactttcctcatagatggtcctgaaacaactgaatgccctaacagcaatagagcctggaactctttggaagttgaggactatggctttgggatttttaccaccaatatatggctaaagttgagagagaaacaagacatggtctgtgactcaaagttgatgtcagcagctgtcaaggatgacagagcagttcatgctgacatgggctattggatagagagcagactgaatgacacatggaagatggaaaaagcatcatttattgaggtcaaaagctgctactggccaaggtcacacaccctctggagcaacggagtgctagagagtgaaatgataattccaaagaatctggctggaccagtgtcgcagcataactacagaccaggctatcacacgcaaacagccggaccatggcatttgggcaaactcgagatggatttcgagttttgtgagggaaccacggtagtggtgaccgaggattgcggaaacagaggaccatccttgagaacaaccactgcctcaggaaaacttataactgagtggtgctgcagatcatgtacattaccaccactgagatacagaggagaggatggatgttggtacggaatggaaattagaccactgaaagaaaaagaagagaacctggtgaactcattggtaacagccggacatggccaaattgacaatttttcactagggattctggggatggcattgctcttggaagagatgcttagaaccagagtaggaacaaagcacgccctgctgctagtggcgatctctttcgtgacactgattacagggaatatgtccttcaaggatttgggaagagtgataatcatggtgggagcagccatgacggacgagatgggcatgggcgtgacatacttggcattactagccgctttcagagtcagacctacctttgcagtggggttgcttttaagaaaacttacttcaaaggaattgttgatggcaaccatcggagtcgtcctcctctctcagagtaacataccaggaacagttttggaactaactgacgcaatagcattgggaataatggttcttaaaatagtgaggagcatggaaaaataccaactagcagtaaccgtcatggctatgctatgtattccaaatgtcatgatactccagcatgcatggaaagtgggttgcaccatattggcagtagtttctgtatcaccactcctcttgacttcctcacaacaaaaaacggactggataccgttagtcctcataataaaaggtctcaatccaactgctattttcttgacaactctgtccagacccaataaaataagaagttggcctcttaatgaagctatcatggcagtaggaatggtgagcatactagcaagttcccttctgaaaaatgacattccaatgacgggaccactggtggcaggaggacttctcacagtgtgctatgtgcttactggcagatcggcagacttggagctagaaaaagcggcagaggtgaaatgggaagatcaagccgagatatctgggagtagcccaatcctatcagtcaccatatcagaagatggtagcatgtcaataaagaatgaggaagaagaacagactttaaccatactgataaggacaggactgttggtaatatcaggactattcccagtgtcaatcccaatcacagctgcggcttggtacctatgggagacaaaaaagcagagggccggagtgctgtgggatgttccttcacctccaccaatgggaaaagctgagctagaagatggcgcttacagaatcaaacagagagggattttcggatactctcaaattggggctggagtgtataaagaaggcacatttcacacgatgtggcacgtcacacgtggagccgtcctagtgcacaaagggaaaagaattgagccatcatgggcggacgtgaagaaagacttgatatcatacggaggaggctggaaactggaaggagaatggaaagaaggcgaagaagttcaggttttagcgctggaacctggaaaaaacccgagagcagtgcaaacaaaacccggcttcttcaaaaccaatacaggaacaataggagccgtatccttagacttttccccaggaacatcaggatccccaatcattgacaagaaaggaaaagtcgtgggtctctacggaaatggtgtcgtgacaagaagcggaacctatgtgagctccatagcccaaacagagacaagcgtggaggacaatccagagattgaagatgatatatttcggaagaaaaggctaaccatcatggacttacatccaggagcgggaaaaacaaaacgatatctcccagccatagttagagaagcaataagaagaggcctgagaacactgattctggcccccaccagagtagtggctgcagaaatggaggaagccctacgggggctcccaatccgttaccagactccagccattaaggcagagcacacagggcgcgaaatcgtagacctaatgtgtcatgccacattcaccatgaggttactatcaccaattagggtaccaaactacaacttaatcataatggatgaagcccatttcacagacccagctagcatagcagctcgaggatacatctccacccgtgtagaaatgggagaagccgctggaatatttatgacagccactcctccaggcagcagggacccgtttccacagagcaatgccccaatagtggacgaggaaagagagattcccgagcgctcatggaattccggacatgaatggataacaaattttaaaggcaaaacagtgtggtttgtcccaagcacaagagctggaaacgacatagcagcctgtttaaggaaaaatgggaaaagagtgattcagctaagcagaaagacctttgatacagaatacaccaaaacaagaacaaatgactgggacttcgtggtcacgactgacatttcagaaatgggggcaaacttcaaagctgaaagagtgatagatccaaggagatgtatgaagccagttatactgacagacggtgaagagcgcgtggttctggcaggacccatgccagtcacccactcaagtgcagcacagagaagaggaaggataggaagaaatcccaaaaatgagaacgaccaatatatttacatgggagaacctttagagaatgatgaagactgtgctcactggaaggaggcaaagatgctccttgataacatcaacacaccagaaggtatcatccccagcatgtttgagccagaacgtgagaaagttgatgccatagacggtgaataccggctaaggggggaagcaaggaaaacttttgtggacctgatgaaaagaggagacctaccagtttggctggcttacaaagtagcttcggaaggcataaactatgcagacaggaagtggtgctttgatggaataagaaacaatcagatcctggaggagaacatggaagtggaagtttggacaaaagaaggtgagaggaaaaaactaaaacccagatggttggatgcaagaacttactcagatccgctagcactcaaagagttcaaggaatttgcggccggaaggaagtctctaaccttgaatttaatcacagaaatgggccggcttccaaccttcatgacccaaaagacaagagatgccctggacaacttggctgtactgcactcygcagaaatgggtggaagagcctataaccatgctctcagtgaattgccagaaactctagaaacattacttctgctaggtcttctggccacagtcacagggggaatctttctgttcttgatgagtggaagaggtgtagggaaaatgaccctcggaatgtgttgcataatcacggccagcggccttctgtggtatgcacagatacagccccattggatagcagcttcaataatattagagttcttcctcatagtactgctaatccctgaaccagagaagcaaagaacaccccaggacaaccagttgacctatgtggttatagccatcctgacgttagtggcagccaccatggcaaacgaaatgggttttctagaaaagacaaagaaagaccttgggttgggaggcatcacaacgcaacaatcagaaataaatatcttggacatagacctccgacctgcatcagcgtggacactgtatgcagtggctactacgtttatcacgccaatgctgaggcacagtatagaaaactcttcagtgaatgtgtcactaacagctatagcaaatcaggccacggtgctcatgggcttgggaaaaggttggccactatcaaaaatggacataggagttcctcttcttgccattggatgctactcacaggtgaatcccataaccctcacagcagcactattgctactagtggcacactatgccatcataggccctggactccaagcaaaggctaccagagaggcgcagaaaagagcagcagccggcatcatgaagaatccaacagtagatgggattacagtgattgacctagaaccaataccctatgatccgaagtttgagaagcagttagggcaagtgatgcttttagtcctttgtgtgacacaggtgctgatgatgagaaccacgtgggctctatgcgaagccctaaccctagcaacggggcccatatcaacactgtgggaaggaaatccaggaaaattttggaacacaacaatagcagtctctatggctaacattttcagagggagttatttggctggagctggactcctcttttccatcatgaggaatacaaccagcgcacgacgaggaaccggcaacataggtgaaactttaggagaaaaatggaagagccggctaaatgcactgggaagaagtgaattccagatatacaagaagagtgggattcaggaggtagacagaaccctggcgaaggaaggcataaaaagaggagaaacagaccaccatgccgtttcacggggctctgcaaagctgagatggtttgttgaaagaaacatggtcgccccagaaggaaaagtagtagaccttggttgtggcagaggaggatggtcatattactgtggtggactaaaaaatgtgagagaagtcaaaggcctgacgaaaggaggaccaggacatgaggagccaatacctatgtcaacatatgggtggaatctagtgcgactgcagagtggagtggatgtattctttattccaccagagagatgcgacacactgctatgcgacataggagaatcgtcaccaaaccccacagtggaggccggacgaacactgagagttctcaatctagtggaaaattggctgggaagcaacacacagttttgcgtaaaagtcctcaacccttacatgccatcagtcatagagagaatggaagcattgcagaggaaatttggaggcgctctagtccgcaatccactctcaaggaattctacgcatgagatgtattgggtgtccaacgcttctggaaatattgtatcttctgtgaacatgatttcaaggatgttgataaatagattcacaatgaggcacaagaaagccacctatgagcctgatgttgatcttgggagtggaacacgcaacattggaattgagtgtgaaacgccaaatatggacataattggaaaacggattgagaaaataaaacaagaacatgaaacgtcatggcactatgaccaagatcatccatacagaacatgggcataccacggcagttatgagacgaaacaaacagggtcagcatcatcaatggtaaatggagtggtcaggctgttgaccaaaccctgggatgtcattcccatggtgacgcaaatggcaatgacagacacaaccccctttggacagcagcgtgttttcaaggaaaaagttgacacaagaacccaggaaccaaaagagggcacgaaaaaattgatgagaatcacagcagagtggctttggggtgagttaggaaggagaaagaagcccagaatctgtacaagagcagagttctgcaacaaagtgagaagcaacgcagctctgggggctgtgttcactgatgagaacaagtggaagtcagcacgcgaagcggtcgaagatgaaagattttgggagctggtggaaagagagagaaacctccaccttgacggaaagtgtgaaacatgcgtgtacaacatgatgggaaaaagagagaagaaactgggagaattcggcaaagcaaaaggcagcagagccatatggtacatgtggctaggtgcccgctttttagaatttgaggccctaggttttttgaacgaagaccattggttctctagagaaaactctcttagtggagtggaaggagaaggactgcacaagctgggctacatcctaagagacatcagcaagaaagcaggaggagcaatgtacgcagatgacactgctggttgggacacaaggatcacatctgaggatctaaagaatgaagaaatgataacaggccaaatggaagggagacataagaagctggcagaggccatattcaaactaacatatcagaataaggtggttcgcgtccaaaggccaaccccaagaggcacggtgatggacatcatttcaaggagggaccaaagaggcagtgggcaggtggggacgtacggtctcaacaccttcaccaatatggaagcacaactaataaggcagatggaaggggaaggactctttaagagcatcctgcatttaacaccccaagaggaaatcgctgtccacgcttggctagttagagagggacgcgaacgcctctcaagaatggcaatcagtggagatgactgcgtcgtgaaaccactagatgacagatttgccagagctttaacagcattgaatgacatgggaaaagtgaggaaagacatacaacagtgggaaccctcaaaaggatggagcgattggacccaagtgcccttttgctctcaccactttcatgaactaataatgaaagatggtcgcaagcttgtagtcccatgcagaagccaggatgaactgataggcagagcgcgtatctcccagggggcaggatggtccttgagagagacagcctgtttggggaagtcatatgcccagatgtggagcttgatgtacttccacaggcgtgatctcaggctggctgctaatgccatctgttcagcagttccatcacattgggttccaaccagcagaacaacttggtccatacatgctagtcatgaatggatgacgacggaagacatgttagcagtctggaacagggtgtggatccaagacaatccatggatggaagacaaaacccccgtggaatcatgggaagacataccatacctaggaaaaagggaagaccagtggtgtggttccctgattggcctaacaagcagggccacctgggcaaggaacattcaaacagccataaaccaagtcagagccctcattggtgaggaggaatacacggattacatgccctcaatgaaaaggttcaggagtgaagaggaggagtcaggagtcctgtggtaa

SEQ ID NO: 745 - DNA, 10176 bp, Dengue virus
atgaataaccaacggaaaaaggcgagaaatacgcctttcaatatgctgaaacgcgagagaaaccgcgtgtcaacaatacaacagttgacgaagagattctcacttggaatgctgcaggggagagggccgttaaagctatttatggccctagtggcgttccttcgtttcctaaccatcccaccaacagcagggatactgaagagatggggaacgatcaaaaaatcaaaggctatcagtgtactgagaggatttagaaaggaaattgggaggatgctgaacattttgaacaggagacgcagaacagcgggcttcctcatcatggtcattccaacagtgatggctttccatttgaccacacgcaatggggagccacacatgattgtcagcaagaatgagaaaggaaagagcctcctttttaaaacagagaatggaataaacatgtgcacccttatggccatggatttaggcgagttgtgcgaggacaccgttacatacaagtgtccctttctcaagcaaaacgagccggaggacatagactgctggtgcaattccacatcaacctgggtgacgtacgggacgtgtagctcgacaggagagcataggagggagaaaaggtcagtcgcacttgtcccacacgtaggaatggggctggaaacgagaactgaaacatggatgtcatcagaaggagcatggaaacaagcccagcggattgagacatggattctgaggcacccaggtttcactcttatggcagctgttttggcgtacacaatagggacaacacatttccaaagagccctaatctttatccttttaactgccgttgctccctcaatgacaatgcgatgtataggcatatcgaaccgagactttgtagagggagtttcaggaggaagctgggttgatattgtcttagaacatgggagctgcgtcacaacaatggccaagaacaaaccaacattagactttgaactaataaaaacagaggccaagcaaccagcaacattgagaaaattctgcattgaagccaaattgaccaacacaacaacagaatctcgctgcccaacccaaggtgaacccagcctagtagaggagcaggacaaaagattcgtttgcaggcattcgatggtggatagaggttggggtaatggatgtggtctgtttgggaaaggaggcattgtgacctgtgcgatgttcacatgcttgaagaaaatggagggaaaagttgtgcagccagaaaacctagagtacaccatagtcataacaccccattcaggagaggaacatgctgtggggaatgatacagggaagcacggcaaggaggttaaaataacaccccaaagctctattgctgaagctgaactaacagattatggcacgatcacgatggaatgctccccacgaacaggtctcgattttaacgagatggtcctgctgcagatggagagcaaagcttggctagtccatagacagtggtttctggacttacctctaccatggcttcctggagcagacacacaagggtccaattggatccagaaagagatgctagtaacattcaaaaatccccatgcgaaaagacaagacgttgtcgtcttgggatcgcaagagggcgccatgcacacagcactcacaggagcaacagaaattcaaatgtcattaggaaacatactatttatggggcatttgaagtgtagactgaggatggacaagctgcaactcaaagggatgtcgtactctatgtgcacaggaaagttcaaagttgtcaaagagatagcggaaacacaacatggaacaatagtcatcagagtgcagtatgaaggagatgactcaccatgcaagattccttttgagatcatggacttggaaaagaaacatgttttagggcgattgatcacggtcaacccaatagtgacagagaaagacaatccaatcaacatagaagcagaacctccatttggtgatagctacattgtcataggagtggagccaggacagctgaaattaaactggtttaaaaaaggaagctctataggacaaatgtttgaaacaacaatgagaggagctaaaagaatggccatcttgggagacacagcttgggactttggatccatagggggagtgttcacatcagtagggaaagcactacatcaagtttttggcgcaatctatggcgccgcctttagcggggtttcatgggctatgaagattctcataggggtggttataacatggataggaatgaattcccgcagcacttccctgtcagtgaccctggtgttagtaggaatcgtgacactatacctgggagtgatggtgcaagcggacagtggttgtgttgtaagctggaagaacaaagaactgaaatgtggaagtgggatctttgtaactgacaatgtgcacacttggacggaacaatacaaatttcaaccagactccccttcaaagctggcttccgcaattcaaaaagctcatgaggaaggaatctgtggaatccgttcagtgacaaggttggaaaatctgatgtggaagcagataacaccagaattgaaccacatcctatccgaaaatgaagtcaaactgaccatcatgacaggagagattaaggggattatgcaagcagggagaagatctttgaaaccccaacctactgagctgagatactcatggaaaacttggggaaaggcgaaggtactatcaacagaactccaaaatcaaactttcctcatagacggtcctgaaacaactgaatgccctaatagcaatagagcctggaactctttggaagttgaggattatggctttgggttttttaccactaacatatggctaaagttgagagagaaacaagacatgatttgtgattcaaagttgatgtcagcagctgttaaggacgacagagcagttcatgctgatatgggctattggatagagagcagactgaatgacacatggaagatggaaaaagcatcatttattgaggttaaaagctgctactggccaagatcacacaccctttggagcaacggagtgctggagagtgaaatgataattccaaagaatctggctggaccagtgtcgcagcacaactacagaccaggctattatacgcaaacagccggaccatggcatttgggcaaactcgagatggatttcgagttttgtgaaggaaccacggtagtggtgaccgaggattgcggaaacagaggaccatccttgagaacaaccactgcctcaggaaaactcataactgagtggtgctgcagatcatgcacactaccaccactaagatatagaggagaggatggatgttggtacggaatggaaattagaccactgaaagaaagagaagagaacctggtgaactcattggttacagccggacatggccaaattgacaatttttcactagggattctgggaatggcactgctcttggaagagatgcttagaaccagagtaggaacaaagcacgccttgctgctagtggcgatctccttcgtgacactgattacagggaatatgtccttcaaggatctaggaagagtgataattatggtgggagcagccatgacggacgagatgggtatgggcgtgacatacttggcattactagctgctttcagagtcagacctacctttgcagtggggttgcttttgagaaaacttacttcaaaggaattgttgatggcaaccatcggagtcgttctcctctctcagagtaacataccaggaacagttttggaactaactgatgcaatagcattgggaataatggttcttaaaatagtgaggagtatggaaaaataccagctagcagtgaccgtcatggctatgctatgtattccaaatgtcatgatactccagcatgcatggaaagtgggctgtaccatattggcagcagtttctgtatcaccactcctcttgacttcctcacaacaaaaaacggactggataccgttagtcttcacaataaaaggtctcaatccgactgctatcttcttaacaactctgtctagacccaataaaacaagaagttggcctctcaatgaagctatcatggcagttggaatggtgagcatattagctagttcccttctgaaaaatgacattccaatgacgggaccactggtggcaggaggacttctcacagtgtgctatgtgcttactggcagatcggcagacttggagctagagaaagccgcagaggtgaaatgggaagatcaagctgagatatctgggagtagcccaatcctatcagtcactatatcagaagatggtagtatgtcaataaagaatgaggaagaagaacagaccttaactatactgataaggacgggactgttagtaatatcaggactattcccagtatcaatcccaatcacagccgcggcctggtacttatgggagacaaaaaagcagagggccggagtgctgtgggacgttccttcacctccaccaatggaaaaagctgagctagaagatggcgcttacagaatcaaacagagagggattctcggatactctcaaattggagctggagtgtataaagaaggtacatttcacacgatgtggcacgtcacacgtggagctgtcctagtgcacaaagggaaaagaattgagccatcatgggcagacgtgaagaaagacttgatatcatatggaggaggctggaaactggaaggagagtggaaagaaggcgaagaagttcaggttttggcgctggaacctggaaaaaacccgagagcagtgcaaacaaaacccggcctcttcaaaaccaatacaggaacaataggagccgtatccctagacttctccccaggaacatcaggatccccaatcattgacaagaaaggaaaggtcgtgggtctctacggaaatggcgtcgtgacaagaagcggaacctatgtgagctccatagcccaaacagagaaaagcgtggaggacaatccagagattgaagatgatatatttcggaagaaaaggctaaccatcatggacttacatccaggagcgggaaaaacaaagcgatacctcccagccatagttagagaagcaataagaagaggcctgagaacactgattctggcccccaccagagtagtggctgcagaaatggaggaagccctacgggggctcccaatccgttatcagactccagccatcaaggcagagcacacagggcgcgaaatcgtagacctaatgtgtcatgccacattcaccatgaggttactgtcaccaattagggtaccaaactacaacttaatcataatggatgaagctcatttcacagacccagctagcatagcagctcgaggatacatctccacccgagtagaaatgggagaagccgctggaatatttatgacagccactcctccaggcagcagggacccttttccacagagcaacgccccaatagtggacgaggaaagagagattcccgaacgctcatggaattccggacatgaatggataacaaactttaaaggcaaaacagtatggtttgtcccgagcataagagctggaaacgacatagcagcctgcttaaggaaaaatgggaaaagagtgattcagctaagtaggaaaacctttgacacagaatacatcaaaacaagaacaaatgactgggacttcgtagtcacgactgacatctcagaaatgggggcaaacttcaaagctgaaagagtgatagatccaaggagatgtatgaagccagttatactgacagatggtgaagagcgtgtggttctggcaggacccatgccagtcactcactcaagtgcagcacagagaagagggagaataggaaggaatccaaaaaatgagaatgaccaatatatctacatgggagaacctttagagaatgatgaagactgtgctcactggaaggaggcaaagatgctccttgataacatcaacacacctgaaggtatcatccccagcatgttcgagccagaacgtgagaaagttgatgccatagacggtgaataccggctaaggggggaagcaaggaagacttttgtggacctgatgaaaagaggagacctaccagtttggctggcttacaaagtagcctcggaaggcataagctatgcagacaggaagtggtgctttgatggaatcagaaataatcagatcctggaggagaacatggaagtggaagtttggacgaaagaaggtgagaggaaaaaactaaaacccagatggttggatgcaagaacttactcagatccgctagcacttaaagagttcaaggaatttgcggccggaaggaagtctctaactctgagtttgatcacagaaatgggtcggctcccaaccttcatgacccaaaagacaagagatgccctggacaacttggctgtactgcactctgcagaaatgggtggaagagcctataaccatgctctcagtgaattgccagaaactttagaaacattactcctgcttggtctcctggccacagtcacagggggaatctttttgttcttgatgagtggaagaggtgtagggaaaatgaccctcggaatgtgttgcataatcacggccagcggccttctgtggtatgcacagatacagccccattggattgcagcctcaataatactagagttctttctcatagtactgctaatccctgaaccagagaagcaaagaacaccccaggacaaccagttgacctatgtggtcatagccatcctgacattagtggcagccaccatggcaaacgaaatgggttttctagaaaagacaaagaaagaccttgggttgggaggtattacaatgcaacaaccagaaataaatatcctggacatagacctccgacctgcatcagcgtggacactatatgcagtggctactacgtttgtcacgccaatgctgaggcacagcatagaaaactcctcagtgaatgtgtcactaacagctatagcaaatcaggccacggtgcttatgggcttgggaaaaggttggccactatcaaaaatggacataggagttcctcttcttgccattggatgctactcgcaggtgaatcccataaccctcacagcagcactactgctgttagtggcacactatgccatcataggccctggactccaagcaaaggctaccagagaggcgcagaaaagagcagcagccggcatcatgaagaatccaacagtagatgggattacagtgattgacctagaacccataccctatgatccgaagtttgagaagcagttagggcaagtgatgctcttggtcctttgtgtgacacaggtgctgatgatgagaaccacgtgggctctatgcgaagccctaaccatagcaacagggcccatatcaacactgtgggaaggaaatccagggaaattctggaacacaacaatagcagtctctatggccaacattttcagagggagttatttggctggagctggactccttttttccatcatgaggaacacaaccagcgcacgaagaggaaccggcaccataggtgaaactttaggagaaaaatggaagagtcggctaaatgcactgggaagaagtgaattccagatatacaagaaaagtgggattcaggaggtagacagaaccctggcgaaggaaggcataaaaagaggagaaacagaccaccatgccgtttcacggggctctgcaaagctgagatggtttgttgaaagaaacatggtcgccccagaaggaaaggtagtagaccttggttgtggcagaggaggatggtcatattactgtggtggactaaaaaatgtgagagaagtcaaaggcctgacgaaaggaggaccaggacatgaggagcctatacctatgtcaacatacgggtggaatctagtgcgactgcagagtggagtggatgtattctttactccaccagagagatgcgacacactgctatgcgacataggagaatcgtcaccaaaccccacagtggaggccggacgaacactgagagttctcaatctagtagaaaattggctggggagcaacacacagttttgcgtaaaagtcctcaacccttacatgccatcagtcatagagagaatggaagcactacagagaaagtttggaggcgctctagttcgcaatccactctcaaggaattccacgcatgagatgtactgggtgtccaacgcttctggaaatattgtgtcttctgtgaacatgatttcaaggatgttgataaatagattcacaatgaggcacaagaaagccacctacgagcctgatgttgatcttggaagtggaacacgcaacattggaattgagtgtgagacgccaaatatggacataattggaaaacggattgagaaaataaaacaagaacatgaaacgtcatggcactatgaccaagatcatccatacaaaacatgggcataccacggcagttatgagacgaaacaaacaggatcagcatcatcaatggtaaacggagtggtcaggctgttgaccaaaccctgggatgtcattcccatggtgacgcaaatggcaatgacagacacaaccccctttggacagcagcgtgttttcaaggaaaaagtagacacaagaacccaggaaccaaaagaaggcacgaaaaaattgatgagaatcacagcaaagtggctttggggtgagttaggaagaagaaagaagcccagaatctgcacaagagcagagttctgcaacaaagtgagaagcaacgcagccctgggggctgtgttcactgatgagaacaagtggaagtcagcacgcgaagcggtcgaagatgaaagattttgggaactggtggaaaaagagagaaaccttcaccttgacggaaagtgtgaaacatgtgtgtacaacatgatgggaaaaagagagaagaaactgggagaattcggcaaagcaaaaggcagcagagccatatggtacatgtggctaggtgcccgctttttggagtttgaggccctaggttttttgaacgaagaccattggttctctagagaaaactctctaagtggagtagaaggagaaggactgcacaagctgggctacatcctaagagacattagcagaaaagcaggaggagcaatgtacgcagatgacactgctggttgggacacaaggatcacatctgaggatctaaagaatgaagaaatgataacagaccaaatggaagggagacataagaagctggcagaggccatattcaaattaacataccagaacaaggtagttcgcgtccaaagaccaaccccaagaggcacggtgatggatatcatttcaaggagagaccaaagaggcagtgggcaggtggggacgtacggtctcaataccttcaccaatatggaagcacaactgataaggcagatggaaggggaaggactctttaagagcatactgcatttaacaccccaagaggaaacagctgtccacgcttggctagttagagagggacgcgaacgcctcgcaagaatggcaatcagtggagatgactgcgtcgtgaaaccactagatgacagattcgccagagctttaacagcattgaatgacatgggaaaagtgaggaaagacatacaacagtgggaaccctcaaaaggatggagtgattggacccaagtgcccttttgctctcaccactttcatgaattaataatgaaagatggtcgcaagcttgtagtcccatgcagaaaccaggatgaactgataggcagagcgcgtatctcccagggggcaggatggtccttgagagagacagcctgtttggggaagtcatatgcccagatgtggagcctgatgtacttccacaggcgtgatctcaggttggctgctaatgccatatgttcagcagttccatcacattgggttccaactagcaggacaacttggtccatacatgctagtcatgaatggatgacgacggaagacatgttagcagtctggaacagggtgtggatccaggacaatccatggatggaagacaagacccccgtggaatcatgggaagacataccatacttagggaaaagggaggaccagtggtgtggttccctgattggcttaacaagcagggccacctgggcaaagaacattcaaacagccataaaccaagtcagagccctcattggtgaggaggaatacacggactacatgccctcaatgaaaaggttcaggagtgaagaggaggagtcaggagtcctgtggtaa

SEQ ID NO: 746 - DNA, 10176 bp, Dengue virus
atgaataaccaacggaaaaaggcgagaaatacgcctttcaatatgctgaaacgcgagagaaaccgcgtgtcaactgtgcagcagctgacaaagagattctcacttggaatgttacagggacgcggaccattgaaactgttcatggccctggtggcattccttcgtttcctaacaatcccgccaacagcagggatattaaaaagatggggaacaatcaaaaaatcaaaggctatcaatgtcttgagagggttcaggaaagagattggaaggatgctgaacatcttgaacaggagacgtagaactgcaggtataattattatgatgattccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttacgggacatgcaccgccacaggagaacacagaagggaaaaaagatcagtggcactagttccacatgtgggaatgggactggagacacgaactgaaacatggatgtcatcagaaggggcctggaaacatgcccagagaattgaaacttgggtcttgagacatccaggcttcaccataatggcagcaatcctggcttacaccataggaacgacatatttccaaagagtcctgatctttatcttactgacaactgtcgctccttcaatgacaatgcgttgtataggaatatcaaatagagactttgtggaaggggtatcaggaggaagctgggttgacatagtcttggaacatggaagctgtgtgacgacgatggcaaaaaataaaccaacattggattttgaactgataaaaacagaagccaaacaccccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgttacgatggaatgctctccgagaacgggcctcgacttcaatgagatggtgttgctgcaaatggaaaacaaggcttggctggtgcacaggcaatggttcttagacctgccattaccatggctgcccggagcagacacacaaggatcaaattggatacagaagaagacattggtcactttcaaaaatccccatgcaaagaaacaggatgttgtcgttttaggatcccaagaaggggccatgcacacagcactcacaggggccacggaaatccagatgtcatcaggaaacttactgttcacaggacatcttaagtgcaggctgagaatggacaaactacagctcaaaggaatgtcatattccatgtgcacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgtcacagaaaaagacagcccagttaacatagaagcagaacctccattcggggacagctacatcattataggagtagaaccaggacaactgaagctcagctggtttaagaaaggaagttctattggccaaatgtttgagacaacaatgagaggagcgaagagaatggccattttaggtgacacagtttgggattttggatccttgggaggggtgttcacatccataggaaaggccctccaccaagtctttggagcaatctatggggctgccttcagtggggtttcatggaccatgaaaatcctcataggagtcgtcatcacatggataggaatgaattcacgcagcacctcactgtctgtgtcactagtgttagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcttcagctatccagaaggctcatgaagaaggcatttgtggaatccgctcagtaacaagactggagaatctgatgtggagacaaataacaccagaattgaatcatattctatcagaaaatgaggtaaagttgactatcatgacaggagacattaaaggaatcatgcaggcaggaaaacgatccctgcggcctcaacccactgagctgaagtactcttggaaagcatggggcaaagcgaaaatgctttccacagagcttcacaaccacacctttctcattgatggccccgaaacagcagaatgtcccaacacaaacagagcttggaactcactagaagttgaagactatggctttggagtatttaccaccaacatatggctgaaattgaaagaaaggcaggatgtattttgtgactcaaaactcatgtcagcagccataaaagacagcagagccgtccacgccgatatgggttactggattgagagcacgttaaatgacacatggaaaatagaaaaagcatctttcattgaagtcaaaagctgccactggccaaggtcacatactctttggagcaacggagttctggaaagtgaaatgataatcccaaaaaatatagcaggaccagtgtcacaacacaattacagaccaggctatcatacacaaacggcaggaccctggcatctaggcaggcttgagatggacttcgatttctgcgaaggaaccacagtggtggtgactgaggactgtggaaatagaggaccctctttaagaacgactactgcttctggaaaactcataacagagtggtgttgccgatcttgcacattaccaccgctaaggtacagaggtgaggatggatgctggtatggaatggaaattagaccattgaaagagaaagaagagaacttggtcaactctttggtcacagccggacatggacagattgataacttttcactaggaattttaggaatggcactgtttctggaagaaatgcttagaactaggataggagcaaagcacacaatactattgacagcaattaccttcgtgacactgatcaccgggaatctttcttacaaagacctagggagggtgataataatggtgggagctgccatgacagatgaaatgggcatgggtgtgacatatcttgccctactggcagctttcaaggttagaccaacctttgcagtgggactcgtgttgcggaaactcacttcaaaagagctgatgatggccactataggaatagtcctactctcccagagcgcactacccaatgacgtcctagctctgacggacgcattggctttagggataatgattctgaaattagtacggaagatggagaaatatcaattggcagcaactgtgatggctttgctgtgcgtgcctaacattatgataattcagaatgcctggaaagtgagctgcacaacactggcagtggtgtccgtttccccactgcttttaacatcctcacggcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggagagagctgctgacgtaagatgggaagaacaggcagagatatcaggaagcagtccaattctgtcgataacaatatcggaagatggtagcatgtcgataaaaaatgaagaagaagaacaaacactgaccatactcatcagaacaggactgttggtgatatcaggactttttcccgtgtcaataccaatcacggcagctgcatggtacctgtgggaagtgaaaaaacaacgagcaggagtattgtgggatgtcccttcacccccacctgtgggaaaggccgaactggaagatggagcctatagaatcaagcagaaagggattctaggatactcgcagatcggagctggagtttacaaagaaggaacatttcacacaatgtggcatgtcacacgtggtgctgtcctaatgcataaagggaagagaattgaaccatcatgggcggacgtcaagaaagatctaatatcgtatggaggaggctggaagctagaaggagaatggaaggaaggagaagaagtccaggtcctggcattagagcctggaaagaatccaagagccgtccaaacaaaacccggcctttttaaaactaacactggaaccataggcgccgtgtctctggacttttctcctggaacgtcaggatctccaatcgtcgacaaaaaaggaaaagttgtgggcctttatggcaacggtgtcgttacaaggagtggaacatatgtgagtgctatagcccagactgaaaaaagcattgaagacaatccagagattgaagatgacatctttcgaaagaaaagattgaccatcatggacctccacccaggagcaggaaaaacaaagagataccttccagcaatagtcagggaagccataaagcgaggcttaagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactgtcaccaattagagtgccaaattacaacctgattatcatggatgaagcccatttcacagacccagcaagcatagcagctagaggatacatttcaactcgagtagagatgggtgaagcagctgggattttcatgacagccacccctcctggaagcagagacccatttcctcagagcaatgcaccaatcatggatgaagaaagggaaatccctgagcgttcgtggaactctggacatgagtgggttacggattttaaagggaagactgtttggtttgttccaagtataaaagcagggaatgacatagcagcttgcctgagaaagaatggaaagaaagtgatacaactcagcaggaagacttttgattctgaatatattaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgacccactctagtgcagcacaaagaagagggagagtaggaagaaatccaaaaaatgagaatgaccagtacatatacatgggggaacctctggaaaatgatgaagactgtgcacactggaaagaagctaaaatgcttctagacaacatcaacacgcctgaaggaatcattcccagcatgttcgaaccagagcgtgaaaaggtggatgccattgatggtgaataccgcttgagaggagaagcgaggaaaactttcgtggacctaatgagaagaggagacctaccagtctggttagcctacagagtggcagctgaaggtatcaattacgcagacagaagatggtgctttgatggagtcaagaacaaccaaatcttggaagaaaatgtggaagtggaaatctggacaaaagaaggagaaaggaagaaactaaaacccagatggttggatgccaggatctactctgacccactggcgctcaaagaattcaaggaattcgcagctggaagaaagtccctgaccctgaatctaatcacagagatgggtaggctcccaaccttcatgacccacaaagcaataaatgcactggataacttagcagtcttgcatacagctgaagcaggcggaagggcgtataatcatgctcttagtgaactgccggagactctggagacattgcttttactgacactcttggccacagtcacgggcggaatcttcctgttcttgatgagcggaaaaggtatagggaagatgaccctgggaatgtgctgcataatcacggccagtattctcctatggtatgcacaaatacagccacactggatagcagcttcaataatactggagttttttctcatagtcttgctcattccagaaccagaaaaacagagaacaccccaagataatcaattaacttatgttgtcatagccatccttacagtggtggccgcaaccatggcaaacgagatgggtttcctggaaaaaacaaagaaagatttcggattgggaagcattacaacccagcaacctgagagcaacatcctggacatagatctacgtcctgcatcagcttggactctatatgccgtggcaacaactttcatcacaccaatgttgagacatagcattgaaaattcctcggtgaatgtgtcattaacggccattgccaaccaggctaccgttttaatggggcttgggaaaggatggccgttgtcaaaaatggacatgggagttcctctattagcaattggatgttactcacaagtaaaccccataactctcacagcagcccttctcctattggtagcacattatgctatcatagggccaggactccaagcgaaagcaactagagaggctcaaaaaagagcagcagcgggcatcatgaaaaacccaactgtggatggaataacagtgattgacctagatccaataccctatgatccaaagtttgaaaagcagttgggacaagtaatgctcttagtcctctgtgtgactcaagtattgatgatgaggactacatgggccttatgtgaagctctaaccttagcaaccgggcccatctctacactgtgggaaggaaatccaggaagattctggaatacaactattgcagtgtcaatggctaacatttttagagggagttacctggccggagccggacttctcttttctatcatgaagaacacggccaacacaagaaggggaactggcaacacaggagagacgcttggagagaaatggaaaaaccggttaaatgcattggggaagagtgaattccagatctataagaaaagtggaatccaggaagtggatagaaccttagcaaaagaaggcatcaaaagaggagaaacggaccatcacgctgtgtcgcgaggctcggcgaaactgagatggttcgtcgagagaaacctggtcacaccagaagggaaagtagtggaccttggttgtggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgttttttttactccgccagaaaagtgtgacacattgctgtgtgacataggggagtcgtcaccaaaccccacggttgaagcaggacgaacactcagagttttaaacttagtggaaaattggctgaacaataacacccaattttgcataaaggttctcaacccatatatgccctcagttatagaaaaaatggaagcgctacaaaggaaatacggaggagctttggtgaggaatccactctcacgaaattccacacacgagatgtactgggtgtccaatgcttccgggaacatagtgtcatcagtgaatatgatttcaagaatgttgattaacagattcacaatgagacacaagaaggccacatacgagccagatgttgacctcggaagtggaacccgcaacatcggaattgaaagtgagacaccagatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgttatccctatggtgacacagatggcaatgacagacacgactccatttggacaacagcgtgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggcgccatattcactgatgagaacaagtggaagtcggcacgtgaggctgttgaagacagtggattttgggaattggttgacaaggaaaggaatctccatcttgaaggaaagtgtgagacatgtgtatataacatgatgggaaagagagagaagaagctaggggagttcggcaaagcgaaaggcagcagagccatatggtacatgtggcttggagcacgcttcttagagtttgaagccctaggattcttgaatgaagatcactggttttccagagagaactccctgagtggagtggaaggagaagggctgcacaaattaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaagaaacttgctgaagccatcttcaaattaacgtaccaaaacaaggtggtgcgcgtgcaaagaccaacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcaactgacagtcacagaagaaattgcagtgaaaaactggttagcaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcctttttgttcacaccatttccatgagttaatcatgaaggacggtcgtgtactcgtagttccatgcagaaatcaagatgaactgattggtagggcccgaatttcccagggagccgggtggtccatgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaagaggaagaggcaggagtcttttggtag

SEQ ID NO: 747 - DNA, 10176 bp, Dengue virus
atgaataaccaacggaaaaaggcgagaaacacgcctttcaatatgctgaaacgcgagagaaaccgcgtgtcaacaatacaacagttgacgaagagattctcacttggaatgctgcaagggagagggccattaaaactatttatggccctagtggcgttccttcgtttcctaaccatcccaccaacagcagggatactgaagagatggggaacgatcaaaaaatcaaaggctatcagtgtactgagaggatttagaaaggaaattgggaggatgctgaacattttgaacaggagacgcagaacagcgggcttccttatcatggttattccaacagtgatggccttccatttgaccacacgcaacggggagccacacatgattgtcagcaagaatgagaaaggaaagagcctcctttttaaaacagagaatggaataaacatgtgcacccttatggccatggatttaggcgagttgtgcgaggacaccgtcacatacaagtgccctttcctcaagcaaaacgagccggaggatatagactgctggtgcaattccacatcaacctgggtgacgtacgggacatgtagctcgacaggagagcataggagggaaaaaaggtcagtcgcacttgtcccacatgtaggaatggggctggaaacgagaactgaaacatggatgtcatcagaaggagcatggaaacaagcccagcggattgagacatggattctgaggcacccaggcttcactcttatggcagctgtcttggcgtacacaatagggacaacacatttccaaagagccctaatcttcatccttttaacagccgttgctccctcgatgacaatgcgatgtataggcatatcaaatcgagacttcgtggagggagtttcaggaggaagctgggttgacatcgtcttagaacacggaagctgcgtcacaacaatggccaagaacaaaccaacattagactttgaactagtaaaaacagaggccaagcaaccagcaacattgagaaaattctgcatagaagccaaattgaccaacacaacaacagaatctcgctgcccaacccaaggtgaacccagcctagtagaggagcaggataaaagattcgtctgcaggcattcgatggtggatagaggctggggtaatggatgtggtctgtttgggaaaggaggtattgtgacctgtgcgatgttcacatgcttgaagraaatggagggaaaagttgtgcagccagaaaacctagagtacaccatagtcataacaccccattcaggagaggaacatgctgtgggggatgatacagggaagcacggcaaggaggttaagataacacctcaaagctctatttctgaagctgaactgacagattatggcacgatcacgatggaatgctccccacgaacaggtctcgattttaatgagatggtcctgctgcagatggagagcaaagcttggctagtccatagacagtggtttctggacttacctctaccatggcttcctggagcagacacacaagggtccaattggatccagaaagagatgctagtaacattcaaaaacccccatgcgaaaagacaggacgttgtcgtcttgggatcgcaagagggcgccatgcacacagcactcacaggagcaacagaaattcaaatgtcattaggaaatatactattcatggggcatttgaagtgtagactgaggatggataagctgcaactcaaagggatgtcgtactccatgtgcacaggaaagtttaaagttgtcaaagagatagcggaaacacaacatggaacgatagtcatcagagtgcagtatgaaggaaatgactcaccatgcaagattccctttgagattatggacttggaaaagaaacatgttttagggcgactgatcacggtcaacccaatagtgacagagaaagacagtccaatcaacatagaagcagaacctccattcggtgatagctacattgtcataggagtggagccaggacagctgaaattaaactggtttaaaaaaggaagctctataggacaaatgtttgaaacaacaatgagaggagctaaaagaatggccatcttgggagacacagcttgggattttggatccataggaggagtgttcacatcagtaggaaaagcactacatcaagtttttggcgcaatctatggcgccgcctttagcggggtttcatggaccatgaagatcctcataggggtggttataacatggataggaatgaactcccgcagcacttccctgtcagtgaccctggtgttggtaggaatcgtgacactatacctgggagtgatggtgcaagcggacagtggttgcgttgtaagctggaagaataaagaactgaaatgtggaagtggaatctttgtgactgacaatgtgcacacttggacggaacagtacaaatttcaaccagactccccttcaaagctggcttctgcaatccaaaaagctcatgaggaaggaatctgtggaatccgttcagttacaaggttggaaaatctgatgtggaagcagataacaccagaattgaaccacatcctatccgaaaatgaagtcaaactgaccatcatgacaggagagatcaaggggattatgcaagcagggagaagatctttgaaaccccaacccactgagctgagatactcatggaaaacttggggaaaagcgaaggtactatcaacagaactccaaaatcagactttcctcatagacggtcctgaaacaactgaatgccctaacagtaatagagcctggaactctttggaagttgaggattatggctttgggatttttaccaccaatatatggctaaagttgagagagaaacaagacatgatttgtgattcaaagttgatgtcagcagctgtcaaggacgacagagcagttcatgctgatatgggctattggatagagagcagactgaatgacacatggaagatggaaaaagcatcatttattgaggttaaaagctgctactggccaagatcacacaccctttggagcaatggagtgctggagagtgaaatgataattccaaagaatctggctggaccagtgtcgcagcacaactacagaccaggctattacacacaaacagccggaccatggcatttgggcaaactcgagatggatttcgagttttgtgaaggaaccacggtagtggtgactgaggattgcggaaacagaggaccatccctgagaacaaccaccgcttcaggaaaacttataactgagtggtgctgcagatcatgcacattaccaccgctaagatacagaggagaggatggatgttggtacggaatggaaattagaccactgaaagaaagagaagagaacctggtgaactcattggttacagccggacatggccaaattgacaatttctcactagggattctgggaatggcattgctcttggaagagatgcttagaaccagagtaggaacaaagcatgccttgctgctagtggcgatctccttcgtgacactgattacagggaatatgtccttcagggatctaggaagagtgataattatggtgggagcagccatgacggacgagatgggtatgggcgtgacatacttggcattactggctgctttcagagtcagacctacctttgcagtggggttgcttttaaggaaactcacttcaaaggaattgttgatggcatccatcggagtcgttctcctctctcagagtaacataccaggaacagttttggaactgactgacgcaatagcattgggaataatggttcttaaaatagtgaggagcatggaaaaataccagctagcagtgaccgtcatggctatgctatgtattccaaatgttatgatactccagcatgcatggaaagtgggttgcaccatattggcagcagtctctgtatcaccactcctcttgacttcctcacaacaaaaaacggactggataccgttagccctcacaataaaaggtctcaatccaactgctattttcttaacaactctgtctagacccagtaaaataagaagttggcctcttaatgaagctatcatggcagttggaatggtgagcatactagctagttccctcttgaaaaatgacattccaatgacgggaccactggtggcaggaggacttctcacagtgtgctatgtgcttactggcagatcggcagacttggagctagaaaaagcggcagaggtgaaatgggaagatcaagctgagatatccgggagtagcccaatcctatcagtcactatatcagaagatggtagtatgtcaataaagaatgaggaagaagagcagactttaaccatactgataaggacaggactgttagtaatatcaggactattcccagtatcaatcccaatcacagccgcggcctggtacctatgggagacaaaaaagcagagggccggagtgctgtgggacgttccttcacctccaccaatgggaaaagctgagctagaagatggcgcttacagaatcaaacagagagggattttcggatactctcaaattggggctggagtgtataaagaaggcacatttcacacgatgtggcacgtcacacgtggagctgtcctagtgcacaaagggaaaagaattgagccatcatgggcagacgtgaagaaagacttgatatcatatggaggaggctggaaactggaaggagagtggaaagaaggcgaagaagttcaggttttagcgctggaacccggaaaaaacccaagagcagtgcaaacaaaacccggcctcttcaaaaccaatacaggaacaataggagccgtttccttagacttttccccaggaacatcaggatccccaatcattgacaagaaaggaaaagttgtgggtctctacggaaatggtgtcgtgacaagaagcggaacctatgtgagctccatagcccaaacagagaaaagcgtagaggacaatccagagattgaagatgatatatttcggaagaaaaggttaaccatcatggacttacatccaggagcggggaaaacaaaacgatatctcccagccatagttagagaagcaataagaagaggcctgagaacactgattctagcccccaccagagtagtggctgcagaaatggaggaagccctacgggggctcccaatccgttaccagactccagccatcaaggcagagcacacagggcgcgaaatcgtagacctaatgtgtcatgccacattcactatgaggttactgtcaccaattagggtaccaaactacaacctaatcataatggatgaagcccatttcacagacccagctagcatagcagctcgaggatacatctccacccgtgtagaaatgggagaagctgctggaatatttatgacagctactcctccaggcagtagggacccttttccacagagcaacgccccaataatggacgaggaaagagagatccctgaacgctcatggaattccggacatgaatggataacaaactttaaaggtaaaacagtatggttcgtcccaagcataagagctggaaacgatatagcagcctgcttaaggaaaaatgggaaaagagtgattcagctgagcaggaaaacctttgacacagaatacaccaaaacaagaacaaacgactgggacttcgtagtcacgactgatatctcagaaatgggggcaaacttcaaagctgaaagagtgatagatccaaggagatgtatgaagccagttatattgacagatggtgaagagcgcgtggttctggcaggacctatgccagttactcactcaagtgcagcacagagaagagggagaataggaaggaacccaaaaaatgagaacgaccaatatatttacatgggagaacctttagagaatgatgaagactgtgctcactggaaggaggcaaagatgctccttgataacatcaacacacctgaaggtatcatccccagcatgttcgagccagaacgtgagaaagttgatgccatagacggtgaataccggttaaggggggaagcaaggaaaacctttgtagacctgatgaaaagaggagacctaccagtttggctggcttacaaagtagcttcggaaggcataaactatgcagacaggaagtggtgctttgatggaatcagaaacaaccagatcctagaggagaacattgaagtggaagtttggacgaaagaaggtgagaggaaaaaactaaaacccagatggctggatgcaagaacttactcagatccgctagcactcaaagagttcaaggaatttgcggccggaaggaagtctctaaccttgagtttgatcacagaaatgggccggctcccaaccttcatgacccaaaagacaagagatgccctggacaacttggctgtattgcactctgcagaagtgggtggaagagcctataaccatgctctcagtgaactgccagaaactctagaaacattactcctgctaggtcttctggccacagtcacagggggaatttttttgttcttgatgagtggaagaggtgtagggaaaatgaccctcggaatgtgttgcataatcacggccagcggccttctgtggtatgcacagatacagccccattggattgcagcttcaataatattggagttctttctcatagtactgctaatccctgaaccagagaagcaaagaacaccccaggacaaccagttgacctatgtggtcatagccatcctgacattagtggcagccaccatggcaaacgaaatgggttttctagaaaagacaaagaaagaccttgggttgggaggcttcacaatgcaacaaccagraataaatattttggacatagacctccgacctgcatcagcgtggacactatatgcagtggctactacgtttttcacgccaatgctgaggcatagcatagaaaactcctcagtaaatgtgtcactaacagctatagcaaaccaggccacggtgcttatgggcttaggaaaaggttggccactatcaaaaatggacataggagttcctcttcttgtcattggatgctactcgcaggtgaatcccataaccctcacagcagcactactgttattggtggcacactatgccatcataggccctggactccaagcaaaggctaccagagaggcgcagaaaagagcagcagctggcatcatgaagaatccaacagtagatgggatcacagtgattgacctagaaccaataccctatgatccgaagtttgagaagcagttagggcaagtgatgcttttggtcctttgtgtgacacaggtgctgatgatgagaaccacgtgggctctatgcgaagccctaaccctagcaacagggcccatatcaacactgtgggaaggaaatccaggaaaattttggaacacaacaatagcagtctctatggctaatattttcagagggagttatttagctggagctggactccttttttccatcatgaggaacacaaccagcgcacgaagaggaaccggcaccataggtgaaactttaggagaaaaatggaagagtcggctaaatgcactgggaagaagtgaattccaaatatacaagaaaagtgggattcaggaagtagacagaaccctggcgaaggaaggcataaaaagaggagaaacagaccaccatgccgtttcacggggctctgcaaagctgagatggtttgttgaaagaaacatggttgctccggagggaaaggtagtagaccttggttgtggcagaggaggatggtcatattactgtggtggactaaaaaatgtgagagaagtcaaaggcctgacgaaaggaggaccaggacatgaggagcctatacctatgtcaacatacgggtggaatctagtgcgactgcagagtggagtggatgtattctttactccaccagagagatgcgacacactgctatgtgacataggagaatcatcaccaaatcccacagtggaggccggacgaacactgagagttctcaatctagtagaaaattggctgggaagcaatacacagttttgcgtaaaagtccttaacccttacatgccatcagtcatagagagaatggaaacactacagagaaagtttggaggcgctctagtccgcaatccactctcaaggaattccacgcacgagatgtactgggtgtccaacgcttctggaaatattgtgtcttctgtgaacatgatttcaaggatgttgataaatagattcacaatgaggcacaagaaagccacctacgagcctgatgttgatcttggaagtggaacacgcaacatcggaattgagtgtgaaacgccaaatatggacataattggaaaacggattgagaaaataaaacaagaacatgaaacgtcatggcactatgatcaagatcatccatacaaaacatgggcataccacggcagttatgagacgaaacaaacaggatcagcatcatcaatggtaaacggagtggtcaggctattgacaaaaccctgggatgtcattcccatggtgacgcaaatggcaatgacagacacaaccccctttggacagcagcgtgttttcaaggaaaaagtagacacaagaacccaggaaccaaaagagggcacgaaaaaattgatgagaatcacagcagagtggctttggggtgagttaggaaggagaaagaggcccagaatctgcacaagagcagagttctgtaataaagtgagaagcaacgcagctctgggggctgtgttcaccgatgagaacaagaggaagtcagcacgcgaagcggtcgaagaagaaagattttgggagctggtggaaaaagagagaaaccttcaccttgatggaaagtgtgaaacatgtgtgtacaacatgatgggaaaaagagagaagaaacttggagaatttggcaaagcaaaaggcagcagagccatatggtatatgtggctaggtgcccgctttttagagtttgaggctctaggttttttgaacgaagaccactggttctctagagaaaattctctaagtggagtggaaggagaaggactgcacaagctgggctacatcctaagagacatcagcaggaaagcaggaggagcaatgtacgcagatgacactgctggttgggacacaaggatcacatctgaggatctgaagaatgaagaaatgataacagaccaaatggaagggagacataagaagctggcagaggccatattcaaactaacatatcagaacaaggtagttcgcgtccaaagaccaaccccaagaggcacggtgatggacatcatttcaaggagagaccaaagaggcagtgggcaggtggggacgtacggtctcaacaccttcaccaatatggaagcacaactgataaggcagatggaaggggaaggacttttcaagagcatactgcacttaacaccccaagaggaaactgctgtccacgcttggctagttagagagggacgcgaacgcctcgcaagaatggcaatcagtggagatgactgcgtcgtgaaaccactagatgacagattcgccagagctttaacagcattgaatgacatgggaaaagtgaggaaagacatacaacagtgggaaccctcaaaaggatggagtgattggacccaagtgcccttttgctctcaccactttcatgaattaataatgaaagatggtcgcaagcttgtagtcccatgcagaaatcaggatgaactgataggcagagcgcgcatctcccagggggcaggatggtccttgagagagacagcctgtttggggaagtcatatgcccagatgtggagcctgatgtacttccacaggcgtgatctcaggttggctgctaatgccatatgttcagcagttccatcacattgggttccaaccagcaggacaacttggtccatacatgctagtcatgaatggatgacgacggaagacatgttagcagtctggaacagggtgtggatccaggacaacccatggatggaagacaagacccccgtggaatcatgggaagacataccatatctagggaaaagggaggaccagtggtgtggttccctgattggcttaacaagcagggccacttgggcaaagaacattcaaacagccataaaccaagtcagagctctcattggtgaggaggaatacatggactacatgccctcaatgaaaaggttcaggagtgaagaggaggaatcaggagtcctgtggtaa

SEQ ID NO: 748 - DNA, 10170 bp, Dengue virus
atgaataaccaacggaaaaaggcgagaaacacgcctttcaatatgctgaaacgcgagagaaaccgcgtgtcaacaacacaacagttgacgaagagattctcacttggaatgctgcaagggagagggccattaaaactatttatggccctagtggcgttccttcgtttcctaaccatcccaccaacagcagggatactgaagagatggggaacgatcaaaaaatcaaaggctatcagtgtactgagaggatttagaaaggaaattgggaggatgctgaacattttgaacaggagacgcagaacagcgggcttccttatcatggttattccaacagtgatggccttccatttgaccacacgcaacggggagccacacatgattgtcagcaagaatgagaaaggaaagagcctcctttttaaaacagagaatggaataaacatgtgcacccttatggccatggatttaggcgagttgtgcgaggacaccgtcacatacaagtgccctttcctcaagcaaaacgagccggaggatatagactgctggtgcaattccacatcaacctgggtgacgtacgggacgtgtagctcgacaggagagcataggagggaaaaaaggtcagtcgcacttgtcccacatgtaggaatggggctggaaacgagaaccgaaacatggatgtcatcagaaggagcatggaaacaagcccagcggattgagacatggattctgaggcacccaggcttcactcttatggcagctgtcttggcgtacacaatagggacaacacatttccaaagagccctaatcttcatccttttaacagccgttgctccctcgatgacaatgcgatgtataggcatatcaaatcgagacttcgtggagggagtttcaggaggaagctgggttgacatcgtcttagaacacggaagctgcgtcacaacaatggccaagaacaaaccaacattagactttgaactaataaaaacagaggccaagcaaccagcaacattgagaaaattctgcatagaagccaaattgaccaacacaacaacagaatctcgctgcccaacccaaggtgaacccagcctagtagaggagcaggataaaagattcgtctgcaggcattcgatggtggatagaggctggggtaatggatgtggtctgtttgggaaaggaggtattgtgacctgtgcgatgttcacatgcttgaagaaaatggagggaaaagttgtgcagccagaaaacctagagtacaccatagtcataacaccccattcaggagaggaacatgctgtggggaatgggaagcacggcaaggaggttaagataacacctcaaagctctatttctgaagctgaactgacagattatggcacgatcacgatggaatgctccccacgaacaggtctcgattttaatgagatggtcctgctgcagatggagagcaaagcttggctagtccatagacagtggtttctggacttacctctaccatggcttcctggagcagacacacaagggtccaattggatccagaaagagatgctagtaacattcaaaaacccccatgcgaaaagacaggacgttgtcgtcttgggatcgcaagagggcgccatgcacacagcactcacaggagcaacagaaattcaaatgtcattaggaaatatactattcatggggcatttgaagtgtagactgaggatggataagctgcaactcaaagggatgtcgtactccatgtgcacaggaaagtttaaagttgtcaaagagatagcggaaacacaacatggaacgatagtcatcagagtgcagtatgaaggagatgactcaccatgcaagattccctttgagattatggacttggaaaagaaacatgttttagggcgactgatcacggtcaacccaatagtgacagagaaagacagtccaatcaacatagaagcagaacctccattcggtgatagttacattgtcataggagtggagccaggacagctgaaattaaactggtttaaaaaaggaagctctataggacaaatgtttgaaacaacaatgagaggagctaaaagaatggccatcttgggagacacagcttgggattttggatccataggaggagtgttcacatcagtaggaaaagcactacatcaagtttttggcgcaatctatggcgccgcctttagcggggtttcatggaccatgaagatcctcataggggtggttataacatggataggaatgaactcccgcagcacttccctgtcagtgaccctggtgttggtaggaatcgtgacactatacctgggagtgatggtgcaagcggacagtggttgcgttgtaagctggaagaataaagaactgaaatgtggaagtggaatctttgtgactgacaatgtgcacacttggacggaacagtacaaatttcaaccagactccccttcaaagctggcttctgcaatccaaaaagctcatgaggaaggaatctgtggaatccgttcagttacaaggttggaaaatctgatgtggaagcagataacaccagaattgaaccacatcctatccgaaaatgaagtcaaactgaccatcatgacaggagagatcaaggggattatgcaagcagggagaagatctttgaaaccccaacccactgagctgagatactcatggaaaacttggggaaaggcgaaggtactatcaacagaactccaaaatcagactttcctcatagacggtcctgaaacaactgaatgccctaacagtaatagagcctggaactctttggaagttgaggattatggctttgggatttttaccaccaatatatggctaaagttgagagagaaacaagacatgatttgtgattcaaaattgatgtcagcagctgtcaaggacgacagagcagttcatgctgatatgggctattggatagagagcagactgaatgacacatggaagatggaaaaagcatcatttattgaggttaaaagctgctactggccaagatcacacaccctttggagcaatggagtgctggagagtgaaatgataattccaaagaatctggctggaccagtgtcgcagcacaactacagaccaggctattacacacaaacagccggaccatggcatttgggcaaactcgagatggatttcgagttttgtgaaggaaccacggtagtggtgactgaggattgcggaaacagaggaccatccctgagaacaaccaccgcttcaggaaaacttataactgagtggtgctgcagatcatgcacattaccaccgctaagatacagaggagaggatggatgttggtacggaatggaaattagaccattgaaagaaagagaagagaacctggtgaactcattggttacagccggacatggccaaattgacaatttctcactagggattctgggaatggcattgctcttggaagagatgcttagaaccagagtaggaacaaagcatgccttgctgctagtggcgatctccttcgtgacactgattacagggaatatgtccttcagggatctaggaagagtgataattatggtgggagcagccatgacggacgagatgggtatgggcgtgacatacttggcattactggctgctttcagagtcagacctacctttgcagtggggttgcttttaaggaaactcacttcaaaggaattgttgatggcaaccatcggagtcgttctcctctctcagagtaacataccaggaacagttttggaactgactgacgcaatagcattgggaataatggttcttaaaatagtgaggagcatggaaaaataccagctagcagtgaccgtcatggctatgctatgtattccaaatgttatgatactccagcatgcatggaaagtaggttgcaccatattggcagcagtctctgtatcaccactcctcttgacttcctcacaacaaaaaacggactggataccgttagccctcacaataaaaggtctcaatccaactgctattttcttaacaactctgtctagacccagcaaaataagaagttggcctcttaatgaagctatcatggcagttggaatggtgagcatactagctagttccctcttgaaaaatgacattccaatgacgggaccactggtggcaggaggacttctcacagtgtgctatgtgcttactggcagatcggcagacttggagctagaaaaagcggcagaggtgaaatgggaagatcaagctgagatatccgggagtagcccaatcctatcagtcactatatcagaagatggtagtatgtcaataaagaatgaggaagaagagcagattttaaccatactgataaggacaggactgttagtaatatcaggactattcccagtatcaatcccaatcacagccgcggcctggtacttatgggagacaaaaaagcagagggccggagtgctgtgggacgttccttcacctccaccaatgggaaaagctgagctagaagatggcgcttacagaatcaaacagagagggattttcggatactctcaaattggggctggagtgtataaagaaggcacatttcacacgatgtggcacgtcacacgtggagctgtcctagtgcacaaagggaaaagaattgagccatcatgggcagacgtgaagaaagacttgatatcatatggaggaggctggaaactggaaggagagtggaaagaaggcgaagaagttcaggttttagcgctggaacccggaaaaaacccaagagcagtgcaaacaaaacccggcctcttcaaaaccaatacaggaacaataggagccgtttccttagacttttccccaggaacatcaggatccccaatcattgacaagaaaggaaaagttgtgggtctctacggaaatggtgtcgtgacaagaagcggaacctatgtgagctccatagcccaaacagagaaaagcgtagaggacaatccagagattgaagatgatatatttcggaagaaaaggttaaccatcatggacttacatccaggagcggggaaaacaaaacgatatctcccagccatagttagagaagcaataagaagaggcctgagaacactgattctagcccccaccagagtagtggctgcagaaatggaggaagccctacgggggctcccaatccgttaccagactccagccatcaaggcagagcacacagggcgcgaaatcgtagacctaatgtgtcatgccacattcactatgaggttactgtcaccaattagggtaccaaactacaacctaatcataatggatgaagcccatttcacagacccagctagcatagcagctcgaggatacatctccacccgtgtagaaatgggagaagctgctggaatatttatgacagccactcctccaggcagtagggacccttttccacagagcaacgccccaataatggacgaggaaagagagatccctgaacgctcatggaattccggacatgaatggataacaaactttaaaggtaaaacagtatggtttgtcccaagcataagagctggaaacgatatagcagcctgcttaaggaaaaatgggaaaagagtgattcagctgagcaggaaaacctttgacacagaatacaccaaaacaagaacaaacgactgggacttcgtagtcacgactgatatctcagaaatgggggcaaacttcaaagctgaaagagtgatagatccaaggagatgtatgaagccagttatattgacagatggtgaagagcgcgtggttctggcaggacctatgccagttactcactcaagtgcagcacagagaagggggagaataggaaggaatccaaaaaatgagaacgaccaatatatttacatgggagaacctttagagaatgatgaagactgtgctcactggaaggaggcaaagatgctccttgataacatcaacacacctgaaggtatcatccccagcatgttcgagccagaacgtgagaaagttgatgccatagacggtgaataccggttaaggggggaagcaaggaaaacctttgtagacctgatgaaaagaggagacctaccagtttggctggcttacaaagtagcttcggaaggcataaactatgcagacaggaagtggtgctttgatggaatcagaaacaaccagatcctagaggagaacattgaagtggaagtttggacgaaagaaggtgagaggaaaaaactaaaacccagatggctggatgcaagaacttactcagatccgctagcactcaaagagttcaaggaatttgcggccggaaggaagtctctaaccttgagtttgatcacagaaatgggccggctcccaaccttcatgacccaaaagacaagagatgccctggacaacttggctgtattgcactctgcagaaatgggtggaagagcctataaccatgctctcagtgaactgccagaaactctagaaacattactcctgctaggtcttctggccacagtcacagggggaatttttttgttcttgatgagtggaagaggtgtagggaaaacgaccctcggaatgtgttgcataatcacggccagcggccttctgtggtatgcacagatacagccccattggattgcagcttcaataatattggagttctttctcatagtactgctaatccctgaaccagagaagcaaagaacaccccaggacaaccagttgacctatgtggtcatagccatcctgacattagtggcagccaccatggcaaacgaaatgggttttctagaaaagacaaagaaagaccttgggttgggaggtttcacaatgcaacaaccagaaataaatattttggacatagacctccgacctgcatcagcgtggacactatatgcagtggctactacgtttttcacgccaatgctgaggcatagcatagaaaactcctcagtaaatgtgtcactaacagctatagcaaaccaggccacggtgcttatgggcttaggaaaaggttggccactatcaaaaatggacataggagttcctcttcttgccattggatgctactcgcaggtgaatcccataaccctcacagcagcactactgttattggtggcacactatgccatcataccccctggactccaagcaaaggctaccagagaggcgcagaaaagagcagcagctggcatcatgaagaatccaacagtagatgggatcacagtgattgacctagaaccaataccctatgatccgaagtttgagaagcagttagggcaagtgatgcttttggtcctttgtgtgacacaggtgctgatgatgagaaccacgtgggctctatgcgaagcactaaccctagcaacagggcccatatcaacactgtgggaaggaaatccaggaaaattttggaacacaacaatagcagtctctatggctaatattttcagaggragttatttagctggagctggactccttttttccatcatgaggaacacaaccagcgcacgaagaggaaccggcaccataggtgaaactttaggagaaaaatggaagagtcggctaaatgcactgggaagaagtgaattccaaatatacaagaaaagtgggattcaggaagtagacagaaccctggcgaaggaaggcataaaaagaggagaaacagaccaccatgccgtttcacggggctctgcaaagctgagatggtttgttgaaagaaacatggttgctccggagggaaaggtagtagaccttggttgtggcagaggaggatggtcatattactgtggtggactaaaaaatgtgagagaagtcaaaggcctgacgaaaggaggaccaggacatgaggagcctatacctatgtcaacatacgggtggaatctagtgcgactgcagagtggagtggatgtattctttactccaccagagagatgcgacacactgctatgtgacataggagaatcatcaccaaatcccacagtggaggccggacgaacactgagagttctcaatctagtagaaaattggctgggaagcaatacacagttttgcgtaaaagtccttaacccttacatgccatcagtcatagagagaatggaaacactacagagaaagtttggaggcgctctagtccgcaatccactctcaaggaattccacgcacgagatgtactgggtgtccaacgcttctggaaatattgtgtcttctgtaaacatgatttcaaggatgttgataaatagattcacaatgaggcacaagaaagccacctacgagcctgatgttgatcttggaagtggaacacgcaacatcggaattgagtgtgaaacgccaaatatggacataattggaaaacggattgagaaaataaaacaagaacatgaaacgtcatggcactatgatcaagatcatccatacaaaacatgggcataccacggcagttatgagacgaaacaaacaggatcagcatcatcaatggtaaacggagtggtcaggctattgacaaaaccctgggatgtcattcccatggtgacgcaaatggcaatgacagacacaaccccctttggacagcagcgtgttttcaaggaaaaagtagacacaagaacccaggaaccaaaagagggcacgaaaaaattgatgagaatcacagcagagtggctttggggtgagttaggaaggagaaagaggcccagaatctgcacaagagcagagttctgtaataaagtgagaagcaacgcagctctgggggctgtgttcaccgatgagaacaagtggaagtcagcacgcgaagcggtcgaagatgaaagattttgggagctggtggaaaaagagagaaaccttcaccttgatggaaagtgtggaacatgtgtgtacaacatgatgggaaaaagagagaagaaacttggagaatttggcaaagcaaaaggcagcagagccatatggtatatgtggctaggtgcccgctttttagagtttgaggctctaggttttttgaacgaagaccattggttctctagagaaaattctctaagtggagtggaaggagaaggactgcacaagctgggctacatcctaagagacatcagcaggaaagcaggaggagcaatgtacgcagatgacactgctggttgggacacaaggatcacatctgaggatctgaagaatgaagaaatgataacagaccaaatggaagggagacataagaagctggcagaggccatattcaaactaacatatcagaacaaggtagttcgcgtccaaagaccaaccccaagaggcacggtgatggacatcatttcaaggagagaccaaagaggcagtgggcaggtggggacgtacggtctcaacaccttcaccaatatggaagcacaactgataaggcagatggaaggggaaggacttttcaagagcatactgcacttaacaccccaagaggaaactgctgtccacgcttggctagttagagagggacgcgaacgcctcgcaagaatggcaatcagtggagatgactgcgtcgtgaaaccactagatgacagattcgccagagctttaacagcattgaatgacatgggaaaagtgaggaaagacatacaacagtgggaaccctcaaaaggatggagtgattggacccaagtgcccttttgctctcaccactttcatgaattaataatgaaagatggtcgcaagcttgtagtcccatgcagaaatcaggatgaactgataggcagagcgcgcatctcccagggggcaggatggtccttgagagagacagcctgtttggggaagtcatatgcccagatgtggagcctgatgtacttccacaggcgtgatctcaggttggctgctaatgccatatgttcagcagttccatcacattgggttccaaccagcaggacaacttggtccatacatgctagtcatgaatggatgacgacggaagacatgttagcagtctggaacagggtgtggatccaggacaacccatggatggaagacaagacccccgtggaatcatgggaagacataccatatctagggaaaagggaggaccagtggtgtggttccctgattggcttaacaagcagggccacttgggcaaagaacattcaaacagccataaaccaagtcagagctctcattggtgaggaggaatacatggactacatgccctcaatgaaaaggttcaggagtgaagaggaggaatcaggagtcctgtggtaa

SEQ ID NO: 749 - DNA, 10176 bp, Dengue virus
atgaataaccaacggaaaaaggcgagaaatacgcctttcaatatgctgaaacgcgagagaaaccgcgtgtcaactgtgcagcagctgacaaagagattctcacttggaatgctacagggacgaggaccattgaaactgttcatggccctggtggcatttcttcgtttcctaacaatcccgccaacagcagggatattaaaaagatggggaacaatcaaaaaatcaaaggctatcaatgtcttgagagggttcaggaaagagattggaaggatgctgaacatcttgaacaggagacgcagaaccgcaggtataattattatgatgattccaacagtgatggcgttccatttaaccacacgcaacggagaaccacacatgatcgtcagtagacaagagaaaggaaaaagtcttctgtttaaaacagagaacggtgtgaacatgtgcaccctcatggccatggaccttggtgaactgtgtgaagacacaatcacttataattgtcctcttctcaagcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacacgcccagagaattgaaacttgggtcttgagacatccaggcttcactgtaatggcagcaatcctggcatacaccataggaacgacatatttccaaagagtcctgattttcatcttgctgacagctgtcgctccttcaatgacaatgcgttgtataggaatatcaaatagagactttgtggaaggggtttcaggaggaagctgggttgacatagtcttggaacatggaagctgtgtgacgacgatggcgaagaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaaaggaggcatcgtgacctgtgcaatgttcacatgtaaaaaaaacatggaaggaaaagtcgtgcaaccagaaaatttggagtacaccattgtgataacacctcactcaggggaagataatgcagtcggaaatgacacaggaaaacacggcaaggaaattaaagtaacaccacagagttccatcacagaagcagaactaacaggctatggcactgtcacgatggaatgctctccaagaacgggtctcgacttcaatgagatggtgttgctgcaaatggaaaacaaagcttggctggtgcacaggcaatggttcttagacctgccgttaccatggctgcccggagcagacacacaaggatcaaactggatacagaaggagacattggtcactttcaaaaatccccatgcaaagaaacaggatgttgttgttttaggatcccaagaaggggctatgcatacagcactcacaggggccacggaaatccagatgtcgtcaggaaacttactgttcacaggacatcttaagtgcaggttgagaatggacaaactacagctcaaaggaatgtcatattccatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcctgattacagtcaacccaattgtcacagaaaaagacagcccagtcaacatagaagcagaacctccattcggagacagctatatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgtagcacctcactgtctgtgtcattagtattagtgggggtcgtgacactgtatttgggagttatggtgcaggccgatagtggttgtgttgtgagttggaaaaacaaagaactgaaatgtggcagtgggatttttattacagacaacgtgcacacatggacagaacaatacaaattccaaccagaatccccttcaaagctggcttcagctattcagaaggctcatgaagaaggcatttgtggaatccgctcagtaacaagactggagaatctgatgtggaaacaaataacaccagaactgaatcacattctatcagaaaatgaggtaaagatgactatcatgacaggagacattaaaggaattatgcaggcaggaaaacgatccctgcggcctcaacccactgagctgaagtactcttggaaagcatggggcaaagcgaaaatgctctccacagaacttcataaccacacctttctcattgatggccccgaaacagcagaatgtcccaacacaaacagagcttggaactcactagaagttgaagactatggctttggagtattcaccactaacatatggctgaaattgaaagaaaggcaggatgtatcttgtgactcaaaactcatgtcagcagccataaaggacaacagagccgtccacgccgacatgggttattggatagaaagcgcactcaatgacacatggaagattgagaaagcctctttcattgaagttaaaagctgccactggccaaagtcacacaccctctggagtaatggagtgctagaaagtgagatgataattccaaagaattttgcaggaccagtatcacaacacaattatagaccaggctatcatacacaaacggcaggaccctggcatctaggtaggcttgagatggactttgatttctgcgaaggaaccacagtggtggtgactgaggactgtggaaatagaggaccctctttaagaacaaccactgcttctggaaaactcataacagagtggtgctgccgatcttgcacattaccaccactaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctaccatgacggatgacataggcatgggcgtgacttatcttgccctattagcagccttcaaagtcagaccaacttttgcagctggactactcttaagaaagctgacctccaaggaattgatgatgaccaccataggaatcgtactcctctcccagagcaccataccagagactatacttgaactgactgacgcgttggctttagggatgatggttcttaaagtagtgagaaacatggaaaagtaccaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaacgaggctattatggcagtcgggatggtgagcattttagccagttctctcttaaaaaatgatattcccatgacaggaccattagtggctggagggcttctcactgtgtgttacgtgctcactggaagatcggctgatttggaactggagagagctgctgacgtaagatgggaagaacaagcagagatatcaggaagtagtccaattctgtcgataacaatatcggaagatggtagcatgtcgataaaaaatgaagaagaagaacaaacactgaccatactcattagaacaggactgctggtgatatcaggactttttcccgtgtcaacaccaatcacggcagctgcatggtacctgtgggaagtgaaaaaacaacgagcaggagtattgtgggatgtcccttcacccccacctgtgggaaaggctgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtgtctctggacttttctcctggaacgtcaggatctccaatcgtcgacaaaaaaggaaaagttgtgggcctttatggtaacggtgtcgtcacaaggagtggaacatatgtgagtgccatagcccagactgaaaaaagcatcgaagacaatccagagattgaagatgacatctttcgaaagaaaagattgaccatcatggaccttcacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggatttttatgacagctacccccccaggaagcagagacccatttcctcagagcaatgcaccaatcatggatgaagaaagggaaatccctgagcgttcgtggaactctggacatgagtgggtcacggattttaaagggaagactgtttggtttgttccaagtataaaagcagggaatgatatagcagcttgcctgagaaagaatggaaagaaagtgatacaactcagcaggaagacctttgattttgaatatatcaagactaggaccaatgattgggactttgtggtcacgacagacatttcagaaatgggtgctaacttcaaggccgagagggttatagaccccagacgctgcatgaaaccagtaatactaacagatggtgaagagcgggtaatcttggcaggacccatgccagtgacccactctagtgcagcacaaagaagagggagagtaggaagaaatccaaaaaatgaaagtgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggacgccattgatggtgaataccgcttgagaggagaagcgaggaaaactttcgtggacctaatgagaagaggagacctaccagtctggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttggatgctaggatctattctgacccactggcgctcaaagaattcaaggaattcgcagctggaagaaagtccctgaccctgaatctaatcacagagatgggcaggctcccaaccttcatgacccagaaagcaaggaatgcactggacaacttagcagtcctgcacacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgttgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtagctgcaaccatggcaaacgagatgggtttcctggaaaaaacaaagaaagattttggattgggaagcagtacaacccagcaacatgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttccccttctcgccatcgggtgctattcacaagtcaaccccataactctcacagcagcccttctctcattggtagcacattatgccatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagctgggacaagtaatgctcttagtcctctgcgtgactcaagtgttgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttctctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacctattcccatgtcaacatacggttggaatctggtgcgtcttcaaagtggagttgatgttttttttactccgccagaaaagtgtgacacattgctgtgtgacataggggagtcatcaccaaaccccacggttgaggcaggaagaacactcagagttctaaacttagtggaaaattggctgaacaacaacacccaattttgcataaaggttctcaacccatatatgccctcagttatagaaaaaatggaagcgctacaaaggaaatacggaggagctttggtgagaaatccactctcacgaaattccacacacgagatgtactgggtatccaatgcttccgggaacatagtgtcatcagtgaacatgatttcaagaatgttaattaacagattcacaatgagacacaagaaggccacatacgagccagatgttgacctcggaagtggaactcgcaatatcggaattgaaagtgagacaccaaatttagacataattgggaaaagaatagaaaaaataaaacaagagcatgaaacatcatggcactatgaccaagaccgcccatacaaaacgtgggcctaccatggcagctacgaaacaaaacagactggatcagcatcatccatggtgaacggagtggttaggctgctaacaaaaccttgggatgtcatccccatggtgacacagatggcaatgacagacacgactccatttggacaacagcgcgttttcaaagagaaggtggacacgagaacccaagaaccgaaagaaggcacgaaaaagctaatgaaaatcacggcagaatggctctggaaagaactaggaaagaaaaagacacctaggatgtgcaccagagaagaattcacaagaaaggtgagaagcaatgcagccttaggtgccatattcatcgatgagaacaagtggaagtcggcacgtgaggctgttgaagacagtggattttgggagttggttgacaaggaaaggaatctccatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctatattttaagagacgtgagtaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtacaaagaccaacaccaagaggcacagtaatggacattatatcgagaagagaccaaagaggtagtggacaagttgtcacttatggcctcaatactttcaccaacatggaagcccaactgatcagacagatggagggagaaggagtcttcaaaagcatccagcaactgacagccacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacagcaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtccttgcgggaaacagcctgtttggggaagtcttacgcccaaatgtggagcctgatgtacttccacagacgcgatcttaggctggcggcaaatgccatttgctcggcagtcccatcacactgggttccaacaagtcgaacaacctggtccatacacgccacacatgagtggatgacaacagaagacatgctgacagtctggaacagggtgtggatccaagaaaacccatggatggaagacaagactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaagaggaagaggcaggagtcttgtggtag

SEQ ID NO: 750 - DNA, 10176 bp, Dengue virus
atgaataaccaacggaaaaaggcgagaaatacgcctttcaatatgctgaaacgcgagagaaaccgcgtgtcaactgtgcagcagctgacaaagagattctcacttggaatgctacagggacgaggaccattgaaactgttcatggccctggtggcatttcttcgtttcctaacaatcccgccaacagcagggatattaaaaagatggggaacaatcaaaaaatcaaaggctatcaatgtcttgagagggttcaggaaagagattggaaggatgctgaacatcttgaacaggagacgcagaaccgcaggtataattattatgatgattccaacagtgatggcgttccatttaaccacacgcaacggagaaccacacatgatcgtcagtagacaagagaaaggaaaaagtcttctgtttaaaacagagaacggtgtgaacatgtgcaccctcatggccatggaccttggtgaactgtgtgaagacacaatcacttataattgtcctcttctcaagcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacacgcccagagaattgaaacttgggtcttgagacatccaggcttcaccgtaatggcagcaatcctggcatacaccataggaacaacatatttccaaagagtcctgattttcatcttgctgacagctgtcgctccttcaatgacaatgcgttgtataggaatatcaaatagagactttgtggaaggggtttcaggaggaagctgggttgacatagtcttggaacatggaagctgtgtgacgacgatggcgaagaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaaaggaggcatcgtgacctgtgcaatgttcacatgtaaaaaaaacatggaaggaaaagtcgtgcaaccagaaaatttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggtctcgacttcaatgagatggtgttgctgcaaatggaaaacaaagcttggctggtgcacaggcaatggttcttagacctgccgttaccatggctgcccggagcagacacacaaggatcaaactggatacagaaggagacattggtcactttcaaaaatccccatgcaaagaaacaggatgttgttgttttaggatcccaagaaggggctatgcatacagcactcacaggggccacggaaatccagatgtcgtcaggaaacttactgttcacaggacatcttaagtgcaggttgagaatggacaaactacagctcaaaggaatgtcatattccatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcctgattacagtcaacccaattgtcacagaaaaagacagcccagtcaacatagaagcagaacctccattcggagacagctatatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgtagcacctcactgtctgtgtcattagtattagtgggggtcgtgacactgtatttgggagttatggtgcaggccgatagtggttgtgttgtgagttggaaaaacaaagaactgaaatgtggcagtgggatttttattacagacaacgtgcacacatggacagaacaatacaaattccaaccagaatccccttcaaagctggcttcagctattcagaaggctcatgaagaaggcatttgtggaatccgctcagtaacaagactggagaatctgatgtggaaacaaataacaccagaactgaatcacattctatcagaaaatgaggtaaagatgactatcatgacaggagacattaaaggaattatgcaggcaggaaaacgatccctgcggcctcaacccactgagctgaagtactcttggaaagcatggggcaaagcgaaaatgctctccacagaacttcataaccacacctttctcattgatggccccgaaacagcagaatgtcccaacacaaacagagcttggaactcactagaagttgaagactatggctttggagtattcaccactaacatatggctgaaattgaaagaaaggcaggatgtatcttgtgactcaaaactcatgtcagcagccataaaggacaacagagccgtccacgccgacatgggttattggatagaaagcgcactcaatgacacatggaagattgagaaagcctctttcattgaagttaaaagctgccactggccaaagtcacacaccctctggagtaatggagtgctagaaagtgagatgataattccaaagaattttgcaggaccagtatcacaacacaattatagaccaggctatcatacacaaacggcaggaccctggcatctaggtaggcttgagatggactttgatttctgcgaaggaaccacagtggtggtgactgaggactgtggaaatagaggaccctctttaagaacaaccactgcttctggaaaactcataacagagtggtgctgccgatcttgcacattaccaccactaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctaccatgacggatgacataggcatgggcgtgacttatcttgccctattagcagccttcaaagtcagaccaacttttgcagctggactactcttaagaaagctgacctccaaggaattgatgatgaccaccataggaatcgtactcctctcccagagcaccataccagagactatacttgaactgactgacgcgttggctttagggatgatggttcttaaagtagtgagaaacatggaaaagtaccaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaacgaggctattatggcagtcgggatggtgagcattttagccagttctctcttaaaaaatgatattcccatgacaggaccattagtggctggagggcttctcactgtgtgttacgtgctcactggaagatcggctgatttggaactggagagagctgctgacgtaagatgggaagaacaagcagagatatcaggaagtagtccaattctgtcgataacaatatcggaagatggtagcatgtcgataaaaaatgaagaagaagaacaaacactgaccatactcattagaacaggactgctggtgatatcaggactttttcccgtgtcaataccaatcacggcagctgcatggtacctgtgggaagtgaaaaaacaacgagcaggagtattgtgggatgtcccttcacccccacctgtgggaaaggctgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtgtctctggacttttctcctggaacgtcaggatctccaatcgtcgacaaaaaaggaaaagttgtgggcctttatggtaacggtgtcgtcacaaggagtggaacatatgtgagtgccatagcccagactgaaaaaagcatcgaagacaatccagagattgaagatgacatctttcgaaagaaaagattgaccatcatggaccttcacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggatttttatgacagctacccccccaggaagcagagacccatttcctcagagcaatgcaccaatcatggatgaagaaagggaaatccctgagcgttcgtggaactctggacatgagtgggtcacggattttaaagggaagactgtttggtttgttccaagtataaaagcagggaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggccgagagggttatagaccccagacgctgcatgaaaccagtaatactaacagatggtgaagagcgggtaatcttggcaggacccatgccagtgacccactctagtgcagcacaaagaagagggagagtaggaagaaatccaaaaaatgaaagtgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggacgccattgatggtgaataccgcttgagaggagaagcgaggaaaactttcgtggacctaatgagaagaggagacctaccagtctggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttggatgctaggatctattctgacccactggcgctcaaagaattcaaggaattcgcagctggaagaaagtccctgaccctgaatctaatcacagagatgggtaggctcccaaccttcatgacccagaaagcaaggaatgcactggacaacttagcagtcctgcacacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgttgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtagctgcaaccatggcaaacgagatgggtttcctggaaaaaacaaagaaagattttggattgggaagcagtacaacccagcaacatgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttccccttctcgccatcgggtgctattcacaagtcaaccccataactctcacagcagcccttctctcattggtagcacattatgccatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagctgggacaagtaatgctcttagtcctctgcgtgactcaagtgttgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttctctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacctattcccatgtcaacatacggttggaatctggtgcgtcttcaaagtggagttgatgttttttttactccgccagaaaagtgtgacacattgctgtgtgacataggggagtcatcaccaaaccccacggttgaggcaggaagaacactcagagttctaaacttagtggaaaattggctgaacaacaacacccaattttgcataaaggttctcaacccatatatgccctcagttatagaaaaaatggaagcgctacaaaggaaatacggaggagctttggtgagaaatccactctcacgaaattccacacacgagatgtactgggtatccaatgcttccgggaacatagtgtcatcagtgaacatgatttcaagaatgttaattaacagattcacaatgagacacaagaaggccacatacgagccagatgttgacctcggaagtggaactcgcaatatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggatgtcatccccatggtgacacagatggcaatgacagacacgactccatttggacaacagcgcgttttcaaagagaaggtggacacgagaacccaagaaccgaaagaaggcacgaaaaagctaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggagttggttgacaaggaaaggaatctccatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctatattttaagagacgtgagtaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtacaaagaccaacaccaagaggcacagtaatggacattatatcgagaagagaccaaagaggtagtggacaagttgtcacttatggcctcaatactttcaccaacatggaagcccaactgatcagacagatggagggagaaggagtcttcaaaagcatccagcaactgacagccacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacagcaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtccttgcgggaaacagcctgtttggggaagtcttacgcccaaatgtggagcctgatgtacttccacagacgcgatcttaggctggcggcaaatgccatttgctcggcagtcccatcacactgggttccaacaagtcgaacaacctggtccatacacgccacacatgagtggatgacaacagaagacatgctgacagtctggaacagggtgtggatccaagaaaacccatggatggaagacaagactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaagaggaagaggcaggagccttgtggtag

SEQ ID NO: 751 - DNA, 10176 bp, Dengue virus
atgaataaccaacggaaaaaggcgagaaatacgcctttcaatatgctgaaacgcgagagaaaccgcgtgtcaactgtgcagcagctgacaaagagattctcacttggaatgctacagggacgaggaccattgaaactgttcatggccctggtggcatttcttcgtttcctaacaatcccgccaacagcagggatattaaaaagatggggaacaatcaaaaaatcaaaggctatcaatgtcttgagagggttcaggaaagagattggaaggatgctgaacatcttgaacaggagacgcagaaccgcaggtataattattatgatgattccaacagtgatggcgttccatttaaccacacgcaacggagaaccacacatgatcgtcagtagacaagagaaaggaaaaagtcttctgtttaaaacagagaacggtgtgaacatgtgcaccctcatggccatggaccttggtgaactgtgtgaagacacaatcacttataattgtcctcttctcaagcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacacgcccagagaattgaaacttgggtcttgagacatccaggcttcaccgtaatggcagcaatcctggcatacaccataggaacgacatatttccaaagagtcctgattttcatcttgctgacagctgtcgctccttcaatgacaatgcgttgtataggaatatcaaatagagactttgtggaaggggtttcaggaggaagctgggttgacatagtcttggaacatggaagctgtgtgacgacgatggcgaagaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaaaggaggcatcgtgacctgtgcaatgttcacatgtaaaaagaacatggaaggaaaagtcgtgcaaccagaaaatttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggtctcgacttcaatgagatggtgttgctgcaaatggaaaacaaagcttggctggtgcacaggcaatggttcttagacctgccgttaccatggctgcccggagcagacacacaaggatcaaactggatacagaaggagacattggtcactttcaaaaatccccatgcaaagaaacaggatgttgttgttttaggatcccaagaaggggctatgcatacagcactcacaggggccacggaaatccagatgtcgtcaggaaacttactgttcacaggacatcttaagtgcaggttgagaatggacaaactacagctcaaaggaatgtcatattccatgtgtacaggaaagtttaaagttgtgaaggaaatagcagaaacacaacatggaacaatagttatcagagtacaatatgaaggggacggttctccgtgcaagatcccttttgaaataatggacttggaaaaaagacatgtcttaggtcgcctgattacagtcaacccaattgtcacagaaaaagacagcccagtcaacatagaagcagaacctccattcggagacagctatatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgtagcacctcactgtctgtgtcattagtattagtgggggtcgtgacactgtatttgggagttatggtgcaggccgatagtggttgtgttgtgagttggaaaaacaaagaactgaaatgtggcagtgggatttttattacagacaacgtgcacacatggacagaacaatacaaattccaaccagaatccccttcaaagctggcttcagctattcagaaggctcatgaagaaggcatttgtggaatccgctcagtaacaagactggagaatctgatgtggaaacaaataacaccagaactgaatcacattctatcagaaaatgaggtaaagatgactatcatgacaggagacattaaaggaattatgcaggcaggaaaacgatccctgcggcctcaacccactgagctgaagtactcttggaaagcatggggcaaagcgaaaatgctctccacagaacttcataaccacacctttctcattgatggccccgaaacagcagaatgtcccaacacaaacagagcttggaactcactagaagttgaagactatggctttggagtattcaccactaacatatggctgaaattgaaagaaaggcaggatgtatcttgtgactcaaaactcatgtcagcagccataaaggacaacagagccgtccacgccgacatgggttattggatagaaagcgcactcaatgacacatggaagattgagaaagcctctttcattgaagttaaaagctgccactggccaaagtcacacaccctctggagtaatggagtgctagaaagtgagatgataattccaaagaattttgcaggaccagtatcacaacacaattatagaccaggctatcatacacaaacggcaggaccctggcatctaggtaggcttgagatggactttgatttctgcgaaggaaccacagtggtggtgactgaggactgtggaaatagaggaccctctttaagaacaaccactgcttctggaaaactcataacagagtggtgctgccgatcttgcacattaccaccactaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctaccatgacggatgacataggcatgggcgtgacttatcttgccctattagcagccttcaaagtcagaccaacttttgcagctggactactcttaagaaagctgacctccaaggaattgatgatgaccaccataggaatcgtactcctctcccagagcaccataccagagactatacttgaactgactgacgcgttggctttagggatgatggttcttaaagtagtgagaaacatggaaaagtaccaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaacgaggctattatggcagtcgggatggtgagcattttagccagttctctcttaaaaaatgatattcccatgacaggaccattagtggctggagggcttctcactgtgtgttacgtgctcactggaagatcggctgatttggaactggagagagctgctgacgtaagatgggaagaacaagcagagatatcaggaagtagtccaattctgtcgataacaatatcggaagatggtagcatgtcgataaaaaatgaagaagaagaacaaatactgaccatactcattagaacaggactgctggtgatatcaggactttttcccgtgtcaataccaatcacggcagctgcatggtacctgtgggaagtgaaaaaacaacgagcaggagtattgtgggatgtcccttcacccccacctgtgggaaaggctgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtgtctctggacttttctcctggaacgtcaggatctccaatcgtcgacaaaaaaggaaaagttgtgggcctttatggtaacggtgtcgtcacaaggagtggaacatatgtgagtgccatagcccagactgaaaaaagcatcgaagacaatccagagattgaagatgacatctttcgaaagaaaagattgaccatcatggaccttcacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggatttttatgacagctacccccccaggaagcagagacccatttcctcagagcaatgcaccaatcatggatgaagaaagggaaatccctgagcgttcgtggaactctggacatgagtgggtcacggattttaaagggaagactgtttggtttgttccaagtataaaagcagggaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggccgagagggttatagaccccagacgctgcatgaaaccagtaatactaacagatggtgaagagcgggtaatcttggcaggacccatgccagtgacccactctagtgcagcacaaagaagagggagagtaggaagaaatccaaaaaatgaaagtgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggacgccattgatggtgaataccgcttgagaggagaagcgaggaaaactttcgtggacctaatgagaagaggagacctaccagtctggctagcctacagagtggcagctgaaggtatcaactacgcagacagaaggtggtgctttgatggagtcaagaacaaccaaatcttggaagaaaatgtggaagtggaaatttggacaaaagaaggagaaaggaagaaattaaaacccagatggttggatgctaggatctattctgacccactggcgctcaaagaattcaaggaattcgcagctggaagaaagtccctgaccctgaatctaatcacagagatgggtaggctcccaaccttcatgacccagaaagcaaggaatgcactggacaacttagcagtcttgcacacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgttgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtagctgcaaccatggcaaacgagatgggtttcctggaaaaaacaaagaaagattttggattgggaagcagtacaacccagcaacatgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttccccttctcgccatcgggtgctattcacaagtcaaccccataactctcacagcagcccttctctcattggtagcacattatgccatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagctgggacaagtaatgctcttagtcctctgcgtgactcaagtgttgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttctctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacctattcccatgtcaacatacggttggaatctggtgcgtcttcaaagtggagttgatgttttttttactccgccagaaaagtgtgacacattgctgtgtgacataggggagtcatcaccaaaccccacggttgaggcaggaagaacactcagagttctaaacttagtggaaaattggctgaacaacaacacccaattttgcataaaggttctcaacccatatatgccctcagttatagaaaaaatggaagcgctacaaaggaaatacggaggagctttggtgagaaatccactctcacgaaattccacacacgagatgtactgggtatccaatgcttccgggaacatagtgtcatcagtgaacatgatttcaagaatgttaattaacagattcacaatgagacacaagaaggccacatacgagccagatgttgacctcggaagtggaactcgcaatatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggatgtcatccccatggtgacacagatggcaatgacagacacgactccatttggacaacagcgcgttttcaaagagaaggtggacacgagaacccaagaaccgaaagaaggcacgaaaaagctaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggagttggttgacaaggaaaggaatctccatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtacaaagaccaacaccaagaggcacagtaatggacattatatcgagaagagaccaaagaggtagtggacaagtcgtcacttatggcctcaatactttcaccaacatggaagcccaactgatcagacagatggagggagaaggagtcttcaaaagcatccagcaactgacagccacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacagcaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtccttgcgggaaacagcctgtttggggaagtcttacgcccaaatgtggagcctgatgtacttccacagacgcgatcttaggctggcggcaaatgccatttgctcggcagtcccatcacactgggttccaacaagtcgaacaacctggtccatacacgccacacatgagtggatgacaacagaagacatgctgacagtctggaacagggtgtggatccaagaaaacccatggatggaagacaagactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaagaggaagaggcaggagtcttgtggtag

SEQ ID NO: 752 - DNA, 10176 bp, Dengue virus
atgaataaccaacggaaaaaggcgagaaatacgcctttcaatatgctgaaacgcgagagaaaccgcgtgtcaactgtgcagcagctgacaaagagattctcacttggaatgctacagggacgaggaccattgaaactgttcatggccctggtggcatttcttcgtttcctaacaatcccgccaacagcagggatattaaaaagatggggaacaatcaaaaaatcaaaggctatcaatgtcttgagagggttcaggaaagagattggaaggatgctgaacatcttgaacaggagacgcagaaccgcaggtataattattatgatgattccaacagtgatggcgttccatttaaccacacgcaacggagaaccacacatgatcgtcagtagacaagagaaaggaaaaagtcttctgtttaaaacagagaacggtgtgaacatgtgcaccctcatggccatggaccttggtgaactgtgtgaagacacaatcacttataattgtcctcttctcaagcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacacgcccagagaattgaaacttgggtcttgagacatccaggcttcaccgtaatggcagcaatcctggcatacaccataggaacgacatatttccaaagagtcctgattttcatcttgctgacagctgtcgctccttcaatgacaatgcgttgtataggaatatcaaatagagactttgtggaaggggtttcaggaggaagctgggttgacatagtcttggaacatggaagctgtgtgacgacgatggcgaagaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaaaggaggcatcgtgacctgtgcaatgttcacatgtaaaaagaacatggaaggaaaagtcgtgcaaccagaaaatttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggtctcgacttcaatgagatggtgttgctgcaaatggaaaacaaagcttggctggtgcacaggcaatggttcttagacctgccgttaccatggctgcccggagcagacacacaaggatcaaactggatacagaaggagacattggtcactttcaaaaatccccatgcaaagaaacaggatgttgttgttttaggatcccaagaaggggctatgcatacagcactcacaggggccacggaaatccagatgtcgtcaggaaacttactgttcacaggacatcttaagtgcaggttgagaatggacaaactacagctcaaaggaatgtcatattccatgtgtacaggaaagtttaaagttgtgaaggaaatagcagaaacacaacatggaacaatagttatcagagtacaatatgaaggggacggttctccgtgcaagatcccttttgaaataatggacttggaaaaaagacatgtcttaggtcgcctgattacagtcaacccaattgtcacagaaaaagacagcccagtcaacatagaagcagaacctccattcggagacagctatatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgtagcacctcactgtctgtgtcattagtattagtgggggtcgtgacactgtatttgggagttatggtgcaggccgatagtggttgtgttgtgagttggaaaaacaaagaactgaaatgtggcagtgggatttttattacagacaacgtgcacacatggacagaacaatacaaattccaaccagaatccccttcaaagctggcttcagctattcagaaggctcatgaagaaggcatttgtggaatccgctcagtaacaagactggagaatctgatgtggaaacaaataacaccagaactgaatcacattctatcagaaaatgaggtaaagatgactatcatgacaggagacattaaaggaattatgcaggcaggaaaacgatccctgcggcctcaacccactgagctgaagtactcttggaaagcatggggcaaagcgaaaatgctctccacagaacttcataaccacacctttctcattgatggccccgaaacagcagaatgtcccaacacaaacagagcttggaactcactagaagttgaagactatggctttggagtattcaccactaacatatggctgaaattgaaagaaaggcaggatgtatcttgtgactcaaaactcatgtcagcagccataaaggacaacagagccgtccacgccgacatgggttattggatagaaagcgcactcaatgacacatggaagattgagaaagcctctttcattgaagttaaaagctgccactggccaaagtcacacaccctctggagtaatggagtgttagaaagtgagatgataattccaaagaattttgcaggaccagtatcacaacacaattatagaccaggctatcatacacaaacggcaggaccctggcatctaggtaggcttgagatggactttgatttctgcgaaggaaccacagtggtggtgactgaggactgtggaaatagaggaccctctttaagaacaaccactgcttctggaaaactcataacagagtggtgctgccgatcttgcacattaccaccactaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctaccatgacggatgacataggcatgggcgtgacttatcttgccctattagcagccttcaaagtcagaccaacttttgcagctggactactcttaagaaagctgacctccaaggaattgatgatgaccaccataggaatcgtactcctctcccagagcaccataccagagactatacttgaactgactgacgcgttggctttagggatgatggttcttaaagtagtgagaaacatggaaaagtaccaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaacgaggctattatggcagtcgggatggtgagcattttagccagttctctcttaaaaaatgatattcccatgacaggaccattagtggctggagggcttctcactgtgtgttacgtgctcactggaagatcggctgatttggaactggagagagctgctgacgtaagatgggaagaacaagcagagatatcaggaagtagtccaattctgtcgataacaatatcggaagatggtagcatgtcgataaaaaatgaagaagaagaacaaacactgaccatactcattagaacaggactgctggtgatatcaggactttttcccgtgtcaataccaatcacggcagctgcatggtacctgtgggaagtgaaaaaacaacgagcaggagtattgtgggatgtcccttcacccccacctgtgggaaaggctgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtgtctctggacttttctcctggaacgtcaggatctccaatcgtcgacaaaaaaggaaaagttgtgggcctttatggtaacggtgtcgtcacaaggagtggaacatatgtgagtgccatagcccagactgaaaaaagcatcgaagacaatccagagattgaagatgacatctttcgaaagaaaagattgaccatcatggaccttcacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggatttttatgacagctacccccccaggaagcagagacccatttcctcagagcaatgcaccaatcatggatgaagaaagggaaatccctgagcgttcgtggaactctggacatgagtgggtcacggattttaaagggaagactgtttggtttgttccaagtataaaagcagggaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggccgagagggttatagaccccagacgctgcatgaaaccagtaatactaacagatggtgaagagcgggtaatcttggcaggacccatgccagtgacccactctagtgcagcacaaagaagagggagagtaggaagaaatccaaaaaatgaaagtgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggacgccattgatggtgaataccgcttgagaggagaagcgaggaaaactttcgtggacctaatgagaagaggagacctaccagtctggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttggatgctaggatctattctgacccactggcgctcaaagaattcaaggaattcgcagctggaagaaagtccctgaccctgaatctaatcacagagatgggtaggctcccaaccttcatgacccagaaagcaaggaatgcactggacaacttagcagtcttgcacacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgttgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtagctgcaaccatggcaaacgagatgggtttcctggaaaaaacaaagaaagattttggattgggaagcagtacaacccagcaacatgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttccccttctcgccatcgggtgctattcacaagtcaaccccataactctcacagcagcccttctctcattggtagcacattatgccatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagctgggacaagtaatgctcttagtcctctgcgtgactcaagtgttgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttctctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacctattcccatgtcaacatacggttggaatctggtgcgtcttcaaagtggagttgatgttttttttactccgccagaaaagtgtgacacattgctgtgtgacataggggagtcatcaccaaaccccacggttgaggcaggaagaacactcagagttctaaacttagtggaaaattggctgaacaacaacacccaattttgcataaaggttctcaacccatatatgccctcagttatagaaaaaatggaagcgctacaaaggaaatacggaggagctttggtgagaaatccactctcacgaaattccacacacgagatgtactgggtatccaatgcttccgggaacatagtgtcatcagtgaacatgatttcaagaatgttaattaacagattcacaatgagacacaagaaggccacatacgagccagatgttgacctcggaagtggaactcgcaatatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggatgtcatccccatggtgacacagatggcaatgacagacacgactccatttggacaacagcgcgttttcaaagagaaggtggacacgagaacccaagaaccgaaagaaggcacgaaaaagctaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggagttggttgacaaggaaaggaatctccatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtacaaagaccaacaccaagaggcacagtaatggacattatatcgagaagagaccaaagaggtagtggacaagttgtcacttatggcctcaatactttcaccaacatggaagcccaactgatcagacagatggagggagaaggagtcttcaaaagcatccagcaactgacagccacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacagcaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtccttgcgggaaacagcctgtttggggaagtcttacgcccaaatgtggagcctgatgtacttccacagacgcgatcttaggctggcggcaaatgccatttgctcggcagtcccatcacactgggttccaacaagtcgaacaacctggtccatacacgccacacatgagtggatgacaacagaagacatgctgacagtctggaacaggttgtggatccaagaaaacccatggatggaagacaagactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaagaggaagaggcaggagtcttgtggtag

SEQ ID NO: 753 - DNA, 10176 bp, Dengue virus
atgaataaccaacggaaaaaggcgagaaatacgcctttcaatatgctgaaacgcgagagaaaccgcgtgtcaactgtgcagcagctgacaaagagattctcacttggaatgctacagggacgaggaccattgaaactgttcatggccctggtggcattccttcgtttcctaacaatcccgccaacagcagggatattaaaaagatggggaacaatcaaaaaatcaaaggctatcaatgtcttgagagggttcaggaaagagattggaaggatgctgaacatcttgaacaggagacgcagaacagcaggtataattattatgatgattccaacagtgatggcgttccatttaaccacacgcaacggagaaccacacatgatcgtcagtagacaagagaaggggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcactataatggcagcaatcctggcttacaccataggaacgacatatttccaaagagtcctgatcttcatcttactgacagctgtcgctccctcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacaccccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaatcgtgcaaccagaaaacttggaatacaccattgtgataacacctcactcaggggaagagaatgcagtcggaaatgacacaggaaaacacggcaaggaaattaaagtaacaccacagagttccatcacagaagcagaactaacaggctatggcactgttacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgtcgttttaggatcccaagaaggggctatgcacacagcactcacaggggccacggaaatccagatgtcatcaggaaacttactgttcacaggacatcttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcctgattacagtcaacccaattgtcacagaaaaagacagcccagtcaacatagaagcagaacctccattcggggacagctacatcattataggagtagaaccaggacaactgaagctcagctggtttaagaaaggaagttctattggccaaatgtttgagacaacaatgagaggagcgaagagaatggccattttaggtgacacagcttgggattttggatccttgggaggggtgttcacatccataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaactgaatcacattctatcagaaaatgaggtaaagctgactatcatgacaggagacattaaaggaatcatgcaggcaggaaaacgatccctgcggcctcaacccactgagctgaagtactcttggaaaacatggggcaaagcgaaaatgctctccacagaactccataaccacacctttctcattgatggccccgaaacagcagaatgtcccaacacaaacagagcttggaactcactagaagttgaagactatggctttggagtattcaccaccaacatatggctgaaattgaaagaaaggcaggatgtattttgtgactcaaaactcatgtcagcagccataaaagacaacagagccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagaatttcgcaggaccagtgtcacaacacaattacagaccaggctatcatacacaaacggcaggaccctggcatctaggcaggcttgagatggactttgatttctgcgaaggaaccacagtggtggtgactgaggactgtggaaatagaggaccctctttaagaacaactactgcttctggaaaactcataacagagtggtgctgccgatcttgcacattaccaccgctaaggtacagaggtgaggatggatgctggtatggaatggaaattagaccattgaaagagaaagaagagaacttggtcaactctttggtcacagccggacatggacagattgacaacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaactgatgatgaccaccataggaatcgtgctcctctcccagagcaccataccagagactatacttgaactgactgacgcgttggctttggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcattgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggagagagctgctgacgtaagatgggaagaacaggcagagatatcaggaagtagtccaattctgtcgataacaatatcggaagatggtagcatgtcgataaaaaatgaagaagaagaacaaacactgaccatactcatcagaacaggactgttggtggtatcaggactctttcccgtgtcaataccaatcacggcagctgcatggtacctgtgggaagtgaaaaaacaacgagcaggagtattgtgggatgtcccttcacccccacctgtgggaaaagccgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagatctaatatcgtatggaggaggctggaagctagaaggagaatggaaggaaggagaagaagtccaggtcctggcattagagcccggaaaaaatccaagagccgtccaaacaaaacccggtctttttaaaactaacactggaaccataggcgccgtgtctctggacttttctcctggaacgtcaggatctccaatcgtcgacaaaaaaggaaaagttgtgggcctttatggcaacggtgtcgttacaaggagtggaacatatgtgagtgctatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccatttcctcagagcaatgcaccaatcatggatgaagaaagggaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaagacttttgattctgaatatattaagactaggaccaatgattgggactttgtggtcacgacagacatttcagaaatgggtgcaaacttcaaggctgagagggtcatagaccccagacgctgtatgaaaccagtcatattaacagacggtgaagagcgggtgatcttggcaggacccatgccagtgacccactctagtgcagcacaaagaagagggagagtaggaagaaatccaaaaaatgaaaatgaccagtacatatacatgggagaacctctggaaaatgatgaagactgtgcacactggaaagaagctaaaatgcttctagacaacatcaacacgcctgaaggaatcattcccagcatgttcgaaccagagcgtgaaaaggtggatgccattgatggtgaataccgcttgagaggagaagcgaggaaaacttttgtggacctaatgagaagaggagacctaccagtctggttagcctacaaagtggcagctgaaggtatcaactacgcagacagaagatggtgctttgatggagtcaagaacaaccaaatcttggaagaaaatgtggaagtggaaatttggacaaaagaaggagaaaggaagaaattaaaacctagatggttggatgctaggatctactctgacccactggcgctcaaagaattcaaggaattcgcagctggaagaaagtccctgaccctgaatctaatcacagagatgggtaggctcccaaccttcatgacccagaaagcaaggaatgcactggacaacttagcagtcttgcatacagctgaagcaggcggaagggcgtacaatcacgctcttagtgaactgccggagactctggagacattgctcttactgactctcttggccacagtcacgggcggaatcttcctgttcttgatgagcggaaagggtatagggaagatgaccctgggaatgtgctgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaagcattacaacccagcaacctgagagcaacatcctggacatagatctacgtcctgcatcagcttggactctatatgccgtggcaacaactttcatcacaccaatgttgagacatagcattgaaaattcttcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcacagcagcccttctcttactggtagcacattatgctatcatagggccaggactccaagcgaaagcaactagagaagctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccaggaagattctggaatacaactattgcagtgtcaatggctaacatttttagagggagttacctggccggagccggacttctcttttctatcatgaagaacacggccaacacaagaaggggaactggcaacacaggagagacgcttggagagaaatggaaaaaccggttgaatacattggggaagagtgaattccagatctataagaaaagtggaatccaggaagtggatagaaccttagcaaaagaaggcatcaaaagaggagaaacagaccatcacgctgtgtcgcgaggctcggcgaaactgagatggttcgtcgagagaaacctggtcacaccagaagggaaagtagtggaccttggttgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacacattgctatgtgacataggggagtcgtcaccaaaccccacggttgaagcaggacgaacactcagagttctaaacttagtggaaaattggctgaacaacaacacccaattttgcataaaggttctcaacccatatatgccctcagttatagaaaaaatggaagcgctacaaaggaaatacggaggagctttggtgaggaatccactctcacgaaattccacacacgagatgtactgggtatccaatgcctccgggaacatagtgtcatcagtgaacatgatttcaagaatgttgattaacagattcacaatgagacacaagaaggccacatacgagccagatgttgacctcggaagtggaacccgcaacatcggaattgaaagtgagataccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacgtaggatgtgcaccagagaagaattcacaagaaaggtgagaagtaatgcagccttaggcgccatattcactgatgagaacaagtggaagtcggcacgtgaggctgttgaagacagtggattttgggaattggttgacaaggaaaggaatctccatcttgaaggaaagtgtgagacatgtgtatataacatgatgggaaagagagagaagaagctaggggagttcggcaaagcgaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactggaggacttaaaaaatgaagaaatggtgacaaaccacatggaaggagaacacaagaaacttgctgaagccatcttcaaattaacgtaccaaaacaaggtggtgcgtgtgcaaagaccaacaccaagaggcacagtaatggacatcatatcgagaagagaccaaagaggtagcggacaagtcgtcacctacggcctcaatactttcaccaacatggaagcccaactgatcagacagatggagggagaaggagtcttcaaaagcatccagcaactgacagtcacagaagaaattgcagtgaaaaactggctagaaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcctttttgttcacaccatttccatgagttaatcatgaaggacggtcgtgtactcgtagttccatgcagaaatcaagatgaactgattggtagggcccgaatttcccagggagccgggtggtccttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaagaggaagaggcaggagtcttgtggtag

SEQ ID NO: 754 - DNA, 10176 bp, Dengue virus
atgaataaccaacggaaaaaggcgagaaatacgcctttcaatatgctgaaacgcgagagaaaccgcgtgtcaactgtgcagcagctgacaaagagattctcacttggaatgctacagggacgaggaccattgaaactgttcatggccctggtggcattccttcgtttcctaacaatcccgccaacagcagggatattaaaaagatggggaacaatcaaaaaatcaaaggctatcaatgtcttgagagggttcaggaaagagattggaaggatgctgaacatcttgaacaggagacgcagaactgcaggtataattattatgatgatcccaacagtgatggcgttccatttaaccacacgcaatggagaaccacacatgatcgtcagtagacaagagaaagggaaaagtcttctgtttaaaacagagaacggtgtgaacatgtgcaccctcatggccatggaccttggtgaactgtgtgaagacacaatcacttacaattgtcctcttctcaggcagaatgaaccagaagacatagactgttggtgcaactctacgtctacatgggtaacttatgggacatgcacagctacaggagaacacagaagggaaaaaagatcagtggcactcgttccacatgtgggaatgggactggagacacgaactgaaacatggatgtcatcagaaggggcctggaaacatgcacagagaattgagacctgggtcttgagacatccaggcttcaccataatggcagcaatcctggcatacaccataggaacgacatatttccaaagagtcctgattttcatcttactgacagctatcgctccttcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgataaagacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatgggggaatggatgcggattatttggaaagggaggtatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggactcgacttcaatgagatggtgttgctgcaaatggaaaacaaggcttggctggtgcacaggcaatggttcttagacctgccatttccatggctgcccggagcagacacacaaggatcaaattggatacagaaggagacattggtcactttcaaaaatcctcatgcaaagaaacaggatgttgttgttttaggatcccaagaaggggctatgcacacagcactcacaggggccacggaaatccagatgtcatcaggaaacttactattcacaggacatcttaaatgtaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgtcacagaaaaagacagcccagtcaacatagaagcagaacctccattcggagacagctatatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaattctcataggagtcgtcatcacatggataggaatgaattcacgcagcacctcactgtctgtgtcactagtattagtgggagtcgtgacattgtatttgggagttatggtgcaggccgatagtggttgcgttgtgagctggaaaaacaaagaactgaaatgtggcagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaactgaatcacattctatcagaaaatgaggtgaagttgaccatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcactagaggttgaagattatggctttggagtattcaccactaacatatggctgaaattgaaagaaaggcaggatgtattttgtgactcaaaactcatgtcagcagccataaaagacaacagagccgtccacgccgacatgggttattggatagaaagcgcactaaatgacacatggaagattgagaaagcctcttttattgaagttaaaagctgccactggccaaagtcacacactctctggagcaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaactacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgcttagaacccgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaggtcagaccaacttttgcagctggactactcttaagaaagctgacctccaaggaattgatgatgaccaccataggaatcgtactcctctctcagagcaccataccagagactatacttgaactgactgacgcgttggctttggggatgatggttctcaaaatagtaagaaacatggaaaagtatcaactagcagtgactatcatggctatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgacattcccatgacaggaccactagtggctggagggcttctcactgtgtgttacgtgctcactggaagatcggctgatttggaactggagagagctgctgacgtaagatgggaagaacaggcagagatatcaggaagcagtccaattctgtcgataacaatatcggaagatggtagcatgtcgataaaaaatgaagaagaagaacaaacactgaccatactgattagaacaggactgctggtgatatcaggactgtttcccgtgtcaataccaatcacggcagctgcatggtacctgtgggaagtgaaaaagcaacgagccggagtattgtgggatgtcccttcacctccacctgtgggaaaggccgaactggaagatggagcctatagaatcaagcagaaagggattctaggatactcgcagataggagccggagtctacaaagaaggaacattccacacaatgtggcatgtcacacgtggtgctgttctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagtggaacatatgtgagtgccatagcccagactgaaaaaagcattgaagacaacccagagattgaagatgacatctttcgaaagaaaagattgaccatcatggacctccacccaggagcaggaaaaacaaagagatatcttccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccatttcctcagagcaacgcaccaatcatggatgaagaaagggaaatccctgagcgttcgtggaactcaggacatgagtgggttacggattttaaagggaagactgtttggtttgttccaagtataaaagcaggaaatgatatagcagcttgcctgagaaagaatggaaagaaagtgatacaactcagcaggaagacttttgatactgaatatatcaagactaggaccaatgattgggactttgtggtcacgacagacatttcagaaatgggtgctaacttcaaggctgagagggttatagaccccagacgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgcgcacactggaaagaagctaagatgcttctagataacatcaacacgcctgaaggaatcattcccagcatgtttgaaccagagcgtgaaaaggtcgacgccattgatggtgaataccgcttgagaggagaagcgaggaaaacatttgtggacctaatgagaagaggggacctaccagtttggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttagatgctaggatctactctgacccactggcgctcaaagaatttaaggaattcgcagctggaagaaaatccctgaccctgaatctaatcaccgagatgggtaggctcccaaccttcatgacccagaaagcaaggaatgcattggacaacttagcagtcctacatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacagccagtattctcctatggtatgcacaaatacagccacattggatagcagcttcaataatactggagttttttctcatagtcttgctcattccagagccagaaaagcagagaacaccccaagataaccaattaacttatgttgtcatagccatccttacagtggtggccgcaaccatggcaaacgagatgggtttcctggaaaaaacaaagaaagatttcggattgggaagcattacaacccagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcgaaaatggacatcggagttccccttctcgctattggatgctattcacaagtcaaccccataaccctcacagcagcccttctcttattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcgaccgggcccatctctacactgtgggaaggaaatccagggagattttggaacacaactattgcagtgtcaatggctaacatttttagagggagttacctggccggagccggacttctcttttctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaactttagcaaaagaaggcatcaagagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgtctccaaagtggagtcgatgtcttttttactccgccagaaaagtgtgacacattgctgtgtgacataggggagtcgtcaccaaaccccacggttgaggcaggacgaacactcagagttctaaacttagtggaaaactggctgaacaacaacacccaattttgcataaaggttcttaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaggccacatacgagccggatgttgatctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccaaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgcttcttagagtttgaagccctaggtttcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggatttgaaaaatgaagaaatggtgacaaaccacatggaaggagaacacaagaaacttgctgaagccattttcagattaacgtaccaaaacaaagtggtgcgtgtgcaaagaccgacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcatctgacagtcacagaagaaattgcagtgaaaaactggttagtaagagtggggcgtgagaggttatcaagaatggccatcagcggagacgattgtgttgtgaaacccttagatgacaggtttgcaagcgctctaacagctctaaatgacatgggaaaggtcaggaaagacatacaacaatgggaaccttcaagaggatggaacgattggacacaagtgcccttttgttcacaccatttccatgagttaatcatgaaggacggtcgtgtacttgtggttccatgtagaaaccaagatgaactgattggtagggcccgaatttcccagggagccgggtggtccttgcgggaaacagcctgtttggggaagtcttacgcccaaatgtggagcctaatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggatccaagaaaacccatggatggaagacaaaactccagtagaatcatgggaggaaatcccatatttggggaagagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 755 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaattaaaaaatcaaaagccattaatgttttgagagggttcaggaaagagatcggaaggatgctggacatcttgaataggagacgcaggtcggcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgctggatttcgaactgataaaaacggaagccaaacagcctgccaccctaagaaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgttccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcgaagagaatggccattttgggtgacacagcctgggactttggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacgacagagtgccctaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgctgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacataactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttaggaatggcattgtttctggaggaaatgcttaggacacgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctgacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgttggcactggagcctggaaaaaatccaagagccgtccaaacaaaacctggtcttttcaaaaccaacaccggaacaataggtgccgtatctctggatttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagctactcccccgggaagtagagatccatttcctcagagcaatgcaccaatcatagatgaagaaagagaaatccctgaacgttcatggaatactggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgttaagactagaaccaatgattgggatttcgtggttacaactgacatttcagaaatgggtgccaatttcaaagctgagagggttatagaccccagacgctgcatgaaaccagtcatactaacagatggagaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatttttttattcttgatgagcgggaggggcatagggaagatgaccctgggaatgtgctgcataatcacggctagcatccttctatggtacgcacaaatacagccacactggatagcagcttcaataatactggagttttttctcatagttttgctcattccagaaccagaaaaacagagaacaccccaagacaaccaattgacctacgttgtaatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgttgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtctttttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccttcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagttatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagcaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggctacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtttttaaaaacatccagcacctgacagtcacagaagaagttgccgtgcaaaactggttggcaagagtggggcgcgaaaggttgtcaagaatggccatcagtggagatgattgtgttgtgaaacctttagatgacaggtttgcaaacgctttgacagccctaaatgacatgggaaagattagaaaagatatacaacaatgggaaccttcaaaaggatggaacgactggacacaagtgcccttctgttcacaccatttccatgagctaatcatgaaggatggtcgtgtacttgttgttccatgtagaaaccaagatgaattgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacttggtctatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 756 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaattaaaaaatcaaaagccattaatgttttgagagggttcaggaaagagatcggaaggatgctgaacatcttgaataggagacgcaggtcggcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctgctgacagctgtcgctccttcaatgacaatgcgttgcataggaatatcaaatagagacttcgtagaaggggtttcaggaggaagttgggttgacatagtcttagaacatggaagctgtgtgacgacgatggcaaaaaacaaaccaacgctggatttcgaactgataaaaacggaagccaaacagcctgccaccctaagaaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgttccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcgaagagaatggccattttgggtgacacagcctgggactttggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctctacagagtcttataaccaaacctttctcattgatggccccgagacgacagagtgccctaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgctgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgtttctggaggaaatgcttaggacacgagtaggaacgaaacatgcaatactactagttgcagtttcttttgtgacattgatcacagggaacatgtccttcaaagacctaggaagagtggtggttatggtaggcgctacaatggcggatgacataggtatgggtgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgttggcactggagcctggaaaaaatccaagagctgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagctactcccccgggaagtagagatccatttcctcagagcaatgcaccaatcatagatgaagaaagagaaatccctgaacgttcatggaatactggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgttaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatttttttattcttgatgagcgggaggggcatagggaagatgaccctgggaatgtgctgcataatcacggctagcatccttctatggtacgcacaaatacagccacactggatagcagcttcaataatactggagttttttctcatagttttgctcattccagaaccagaaaaacagagaacaccccaagacaaccaattgacctacgttgtaatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgttgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtctttttcatcccgccagaaaagtgtgacacattgttgtgtgatataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaatatcatggcactacgaccaagatcacccatacaaaacgtgggcataccatggtagttatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggctacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtttttaaaaacatccagcacctgacagtcacagaagaagttgccgtgcaaaactggttggcaagagtggggcgcgaaaggttgtcaagaatggccatcagtggagatgattgtgttgtgaaacctttagatgacaggtttgcaaacgctttgacagccctaaatgacatgggaaagattagaaaagatatacaacaatgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacttggtctatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 757 - DNA, 10176 bp, Dengue virus
atgaataaccaacggaaaaaggcgagaagtacgcctttcaatatgctgaaacgcgagagaaaccgcgtgtcgactgtgcaacagttgacaaagagattctcacttggaatgctgcaaggacgaggaccgttaaaactgttcatggcccttgtggcgttccttcgtttcctaacaatcccaccaacagcagggatactgaaaagatggggaacgatcaaaaaatcaaaagctatcaatgttttgagagggttcaggaaagaaattggaaggatgctgaacatcttgaacagaagacgcaggacagcaggcgtgattattatgttgattccaacagcgatggcgttccatctaaccacacgtaatggagaaccacacatgatcgttggtagacaagagaaagggaaaagtcttctgttcaaaacggaggatggtgtgaacatgtgtaccctcatggccatagatcttggtgaattgtgtgaagatacaatcacgtacaagtgccccctcctcaggcagaatgaaccagaagacatagattgttggtgtaactccacgtccacatgggtaacttatgggacgtgcaccaccacaggagaacacagaagagaaaaaagatcagtggcactcgttccacatgtgggtatgggactggagacacgaactgaaacatggatgtcgtcagaaggagcctggaaacacgctcagagaattgaaacctggatcttgagacatccaggctttaccataatggcagcaatcctggcatacaccataggaacgacacatttccaaagggccctgattttcatcttactgacagctgtcgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaacagaagccaaacaacctgccactttaaggaagtactgtatagaagcaaagctgaccaacacaacaacagaatctcgttgcccaacacaaggggaacccagtctaaatgaagagcaggacaaaaggttcgtctgcaaacactccatggtggacagaggatggggaaatggatgtggattatttggaaagggaggcatcgtgacctgtgctatgtttacatgcaaaaagaacatggaaggaaaaatcgtgcagccggaaaatttggaatacaccatcgtgataacacctcactcaggagaagagcatgccgtaggtaatgacacaggaaaacatggtaaggaaatcaaaataacaccacagagttccaacacagaagcagaactgacaggctatggcacagttacgatggagtgctctccgagaacgggccttgattttaatgagatggtgctgctgcagatggaagacaaagcttggctggtgcacaggcagtggttcctagacctgccgttaccatggctacccggagcggacacacaaggatcaaattggatacagaaagagacactggtcaccttcaaaaatcctcacgcgaagaaacaggatgtcgttgttttaggatctcaagaaggggcaatgcacacggcactcacaggggccacagagatccagatgtcatcaggaaacttactattcacaggacatctcaagtgcaggctgagaatggacaaactacagctcaaaggaatgtcgtactctatgtgcacaggaaagttcaaaattgtgaaggaaatagcagaaacacaacatggaacaatagttattagagtacaatatgaaggagacggctctccatgtaagatcccttttgaaataatggatttagaaaaaagacatgttttaggtcgcctgattacagttaacccgatcgtaacagaaaaagatagcccagtcaacatagaagcagaacctccattcggagacagctacatcattataggagtagagccgggacaattgaaactcaactggtttaagaaaggaagttccattggccaaatgtttgagacaacaatgagaggagcgaagaggatggccatcttaggtgacacagcctgggattttggatccctaggaggagtgtttacatctataggaaaagctctccaccaagttttcggagcaatctatggggctgcctttagtggggtctcatggactatgaaaatcctcataggagccatcatcacatggataggaatgaattcacgtagcacctcactgtctgtgtcactagtattggtgggagtcataacactgtacttgggagccatggtgcaggctgatagtggttgcgttgtgagctggaaaaacaaagaactgaaatgtggcagcgggatcttcatcacagataacgtgcacacatggacagagcaatacaagttccaaccagaatccccttcaaaattagcttcagctatccagaaagctcatgaagagggcatttgtgggattcgttcagtaacaagattggagaatctgatgtggaaacaaataacaccagaattgaaccacattctatcagaaaatgaggtaaagttgaccatcatgacaggagatattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggctttggagttttcaccaccaacatatggctaaaattgagagaaaaacaggatgtgttttgtgactcaaaactcatgtcagcagccataaaagacaacagagccgtccatgccgatatgggttactggatagaaagtgcactcaatgacacatggaagatggaaaaggcctccttcattgaagttaaaagctgccactggccaaagtcacacaccctctggagcaatggagtattagaaagtgagatgataattccaaaaagttttgctgggccagtgtcacaacacaactacagaccaggctattacacgcaaacagcaggaccttggcatctaggtaagcttgaaatggacttcgatttctgcgaaggaactacagtggtggtgactgaggactgcggaaatagaggaccctctttaagaacgaccactgcctctggaaaacttataacagaatggtgctgccgatcctgcacattaccacctctaagatacagaggtgaggatggatgctggtatgggatggaaatcagaccattaaaagagaaagaagagaatttggtcaactccttggtcacagcaggacatgggcagattgacaacttctcactaggagtcttgggaatggcactattcttggaagaaatgctcaggacacgagtaggaacgaaacatgcaatactgctagttgcagtttcctttatgacattgattactgggaacatgtcctttagagacctgggaagagtgatggttatggtgggcgctaccatgacggatgacataggtatgggagtgacttatcttgccctactagcagctttcaaagttagaccaactttcgcagctggactactactgagaaagctgacctccaaggaattaatgatggctaccataggaattgcactcctttctcaaagcaccataccagagaccattcttgaactaactgatgcgttagccttgggcatgatggtcctaaaaatagtgagaaatatggaaaagtaccaattggcagtgactatcatggctatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatctttctaacaactctttcgagaaccagcaagaaaaggagctggccgctaaatgaggctatcatggctgtcgggatggtgagcattttagccagttccctcttaaaaaatgacattcccatgacaggtccattagtggctggagggctccttactgtgtgctacgtgctcactggacgatcggccgatttggaactggagagagccaccgatgtcaaatgggaagatcaggcagaaatatcaggaagcagcccaatcctgtcaataacaatatcagaagatggcagcatgtcgataaagaatgaagaggaagaacaaacactgaccatactcatcagaacgggattgctagtgatctcaggactctttccagtgtcaataccaattacggcagcagcatggtacctgtgggaagtgaagaaacaacgggctggagtattgtgggacgtcccttcacccccacccgtgggaaaggctgaactggaagatggagcctatagaatcaagcagaaagggattcttggatactcccagattggagccggagtttacaaagaaggaacattccatacaatgtggcacgtcacacgtggcgctgttctgatgcatagagggaagaggattgaaccatcatgggcggacgtcaagaaagacctaatatcatatggaggaggctggaaactcgaaggagaatggaaggaaggagaggaagtccaagtcctggcattggaacctggaaaaaatccaagagctgttcaaacgaaacctggacttttcaaaaccaacaccggaaccataggcgccgtatctctggacttttctcctggaacgtcaggatccccaattgtcgacagaaaaggaaaagttgtgggtctttatggcaatggtgttgtcacaaggagtggagcatacgtgagtgctatagcccagaccgaaaaaagcattgaagacaatccagagattgaagatgacattttccgaaagaaaagattgactatcatggacctccatccaggagcgggaaagacaaaaagataccttccagccatagttagagaagccataaaacgtggcttaagaacattaatcctagcccccactagagtcgtggcagctgaaatggaggaagctcttagaggacttccaataagataccaaaccccagccatcagagccgagcacaccgggcgggagattgtggacctaatgtgtcatgccacgtttactatgaggctgctatcaccagtcagagtgccaaattacaacctgatcatcatggatgaagctcacttcacagacccagcaagtatagcagctagaggatacatttcaactcgagtagagatgggtgaagcagctgggattttcatgacagccactcctccgggaagtagagacccatttcctcagagcaatgcaccaatcatagatgaggaaagagaaatccctgagcgttcgtggagctctggacatgaatgggtcacggattttaaagggaagactgtttggtttgttccaagtataaaagcgggaaatgacatagcagcttgtctcaggaaaaatggaaagaaagtgatacaactcagcaggaagacctttgactctgagtatgttaagactaggaccaatgattgggactttgtggtcacaaccgacatttcagaaatgggtgctaacttcaaggctgagagggttatagaccccagacgttgcatgaaaccagttatactaacagatggtgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcgcattggaaagaagctaaaatgctcctagataacatcaacacacctgaaggaatcattcctagtatgttcgaaccagagcgtgaaaaggtggatgccattgatggtgaataccgcttgagaggagaagcaaggaaaacctttgtggacctaatgagaagaggggacttaccagtctggctggcctacagagtggcagctgaaggcatcaactacgcagacagaaggtggtgttttgatggagttaagaataaccaaatactggaagaaaacgtggaagtggaaatttggacaaaagagggggaaaggaagaaattaaaacccagatggttggacgctaggatctattctgacccactggcactaaaagaattcaaggaatttgcagctggaagaaagtccctaaccctgaacctaatcacagaaatgggtaggcttccaactttcatgactcaaaaagcaagagatgcactggataacctagctgtgctgcatacggctgaggcaggtggaagagcgtacaatcatgctctcagtgaactgccggagaccctggagacactgcttttactgacacttctggctacagtcacgggaggaatcttcttattcttaatgagcggaaaaggtgtagggaagatgaccctgggaatgttctgcataatcacggctagcatcctcctatggtatgcacagatacaaccacactggatagccgcttcaataatactggagttttttctcatagttttgctcattccagaaccagaaaaacagagaacaccccaagataaccaattgacctacgttgtcatagccatcctcacagtagtggccgcaaccatggcaaacgaaatgggttttctggaaaaaaccaagaaagacctcggactgggaagcattgcaactcaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttcccctccttgccattggatgttactcacaagtcaaccccataactctcacagcagctcttcttttattgatagcacattatgccattatagggccaggacttcaagcgaaagcaaccagagaagctcagaaaagagcagcagcaggcatcatgaaaaacccaacagtcgatggaataacagtgatcgacctagatccaataccctatgatccaaaatttgaaaaacagttaggacaagtaatgctcctaattctctgcgtgactcaagtattaatgatgaggactacatgggctctgtgtgaggctctaaccttagcgaccgggcccatctccacattgtgggaaggcaatccagggaggttttggaacactaccattgcagtgtcaatggctaacatttttagagggagctacttggctggagctggacttcttttttccatcatgaagaatacaacaaatacaagaagaggaactggcaacataggagagacgcttggagagaaatggaaaagccgattgaacgcactgggaaaaagtgaatttcagatttacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgtggtagagggggctggtcatactattgtgggggactaaagaatgtaagagaagtcaaaggcctgacaaaaggaggaccaggacacgaggaacctatccccatgtcaacatatgggtggaatctagtacgtctgcagagtggagttgatgttttcttcactccgccagaaaagtgtgacacactgttgtgtgacataggggagtcgtcaccaaatcccacgatagaagcaggacgaacactcagagtcctcagcttggtggaaaattggttgaacaatgacactcaattttgcataaaggttctcaacccatacatgccctcagttatagaaaaaatggaaacactgcagaggaaatatggaggagccttagtgaggaatccactctcacgaaactccacacatgagatgtactgggtatccaatgctactgggaacatagtgtcatcagtgaacatgatttcaaggatgctgattaacagattcacaatgaaacacaagaaagccacctacgagccagatgttgacctagggagcggaacccgcaacattggaattgaaagtgagataccaaatctagacataataggaaagagaatagagaaaataaagcaagagcatgaaacatcatggcactatgaccaagaccacccatataaaacatgggcttaccatggcagctatgaaacaaaacagactggatcagcatcatccatggtgaacggagtggtcagactactgacaaaaccttgggacgtcgtccctatggtaacacagatggcaatgacagatacgaccccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggagccatattcactgatgagaacaaatggaagtcggcacgcgaggctgttgaagatagtaggttttgggagctggttgacaaggaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcttggagtttgaagccctgggattcttgaatgaagatcactggttctctagagagaactccctgagtggagtggaaggagaagggctgcacaagctaggctacattctaagagacgtgagcaagaaggaaggaggagcaatgtacgccgatgatacagcaggatgggacacaagaatcacactagaggacttaaaaaatgaagaaatggtgacaaaccacatggaaggagaacacaagagactagccgaggccatatttaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagctcaattaattagacagatggagggagaaggaattttcaaaagcattcagcacctgacagtcacagaagaaatcgctgtacagaactggttggcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccttcaaaaggatggaacgattggacacaagtgcctttctgttcacaccattttcatgagttaatcatgaaagacggccgcgtgcttgtggttccatgcagaaaccaagatgaactgattggcagggcccgaatttctcagggagctgggtggtctttgaaagagactgcctgtttggggaagtcttacgcccaaatgtggagcctgatgtacttccacagacgtgacctcaggctggcggcaaatgctatttgctcggcagtcccgtcacattgggttcctacaagtcgaacaacctggtctatacacgccaaacatgaatggatgacgacggaagacatgctgacagtctggaacagggtgtggatccaagaaaacccatggatggaagacaaaactccagtggagtcatgggaggaagtcccatatttgggaaaaagagaagaccaatggtgcggctcattgattgggctaacaagcagggctacctgggcaaagaacatccaaacagcaataaatcaagtcagatcccttataggcaatgaagaatacacagattacatgccatccatgaagagattcagaagggaagaggaagaggcaggtgtcctgtggtag

SEQ ID NO: 758 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaattaaaaaatcaaaagccattaatgttttgagagggttcaggaaagagatcggaaggatgctgaacatcttgaataggagacgcaggtcggcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgctggatttcgaactgataaaaacggaagccaaacagcctgccaccctaagaaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgttccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcgaagagaatggccattttgggtgacacagcctgggactttggatccctgggaggagtgtttacatctataggaaaagctctccaccaagtctttggagcaatctatggagctgccttcagtggggtttcatggaccttgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacgacagagtgccctaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgctgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgttggtacgggatggaaatcagaccattgaaagagaaagaagaaaatctggttaactccttggtcacagccggacatgggcaggttgacaatttttcactgggagtcttgggaatggcattgtttctggaggaaatgcttaggacacgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgttggcactggagcctggaaaaaatccaagagccgtccaaacaaaacctggtcttttcaaaaccaacaccggaacaataggagccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagctactcccccgggaagtagagatccatttcctcagagcaatgcaccaatcatagatgaagaaagagaaatccctgaacgttcatggaatactggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgttaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatttttttattcttgatgagcgggaggggcatagggaagatgaccctgggaatgtgctgcataatcacggctagcatccttctatggtacgcacaaatacagccacactggatagcagcttcaataatactggaattttttctcatagttttgctcattccagaaccagaaaaacagagaacaccccaagacaaccaattgacctacgttgtaatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgttgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtctttttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagttatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggctacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtttttaaaaacatccagcacctgacagtcacagaagaagttgccgtgcaaaactggttggcaagagtggggcgcgaaaggttgtcaagaatggccatcagtggagatgattgtgttgtgaaacctttagatgacaggtttgcaaacgctttgacagccctaaatgacatgggaaagattagaaaagatatacaacaatgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacttggtctatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 759 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaataaaaaaatcaaaagccattaatgttttgagagggttcaggaaagagatcggaaggatgctgaacatcttgaataggagacgcaggtcggcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgtaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgctggatttcgaactgataaaaacggaagccaaacagcctgccaccctaagaaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgttccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaattccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcgaagagaatggccattttgggtgacacagcctgggactttggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacgacagagtgccctaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgctgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgtttctggaggaaatgcttaggacacgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcccatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgttggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagctactcccccgggaagtagagatccatttcctcagagcaatgcaccaatcatagatgaagaaagagaaatccctgaacgttcatggaatactggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgttaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatttttttattcttgatgagcgggaggggcatagggaagatgaccctgggaatgtgctgcataatcacggctagcatccttctatggtacgcacaaatacagccacactggatagcagcttcaataatactggagttttttctcatagttttgctcattccagaaccagaaaaacagagaacaccccaagacaaccaattgacctacgttgtaatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggactccaagcaaaagcaaccagagaagcccagaaaagagcagcggccggcatcatgaaaaacccaaccgttgatggaataacagtgattgatctggatccaataccttatgatccaaagtttgaaaagcagttgggacaagtaatgctactaatcctctgcgtgactcaagtgttgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaatataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtctttttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagttatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggctacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggcacctatggactcaatactttcaccaatatggaagcccaattaatcagacagatggagggagaaggagtttttaaaaacatccagcacctgacagtcacagaagaagttgccgtgcaaaactggttggcaagagtggggcgcgaaaggttgtcaagaatggccatcagtggagatgattgtgttgtgaaacctttagatgacaggtttgcaaacgctttgacagccctaaatgacatgggaaagattagaaaagatatacaacaatgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacttggtctatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 760 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactaaaaagatggggaacaatcaaaaaatcaaaagctatcaatgttttgagagggttcaggaaagagattggaaggatgctgaacatcttgaacaggagacgcaggacagcaggcgtgattgttatgttgattccaacagcgatggcgtttcatttaaccacacgcaatggagaaccacacatgatcgttggtaggcaggagaaaggaaaaagtcttctgttcaaaacagaggatggtgtcaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccactacaggggaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagttgaccaacacaacaacagaatctcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtgcagccagaaaatttggaatacaccatcatgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtacacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcatacggcactcacaggggccacagaaatccagatgtcatcaggaaacttactgttcacaggacatctcaagtgcaggctgagaatggacaaactacagctcaaaggaatgtcatactctatgtgcacaggaaagtttaaaattgtgaaggaaatagcagaaacacaacatggaacaatagttatcagagtacaatatgaaggggatggttctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggattttggatccctgggaggagtgtttacatctgtaggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactatacctgggagctatggtgcaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctctgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagtcgaagactatggttttggagtttttaccaccaatatatggctaaaattgagagaaaaacaggatgtattttgtgactcaaaactcatgtcagcggccattaaagacaacagagccgtccatgctgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggcaagcttgagatggactttgatttctgcgaaggaactacagtggtggtgactgaggactgtggaaatagaggaccttctttaagaacgaccactgcctctggaaaactcataacagaatggtgctgccgatcctgtacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggtgctaccatgacggatgacataggtatgggagtgacttatcttgccctactagcagctttcaaagttagaccaacttttgcagctggactactcttgagaaaactgacctccaaggaattaatgatggccaccataggaatcgctctcctttcccaaagcaccataccagagaccattcttgaactgactgatgcgttagccttgggcatgatggctctcaaaatagtgaaaaatatggaaaagtaccaattggcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacgactctttcgagaaccagcaagaaaaggagctggccgctaaatgaagctatcatggcagttgggatggtgagcattttagccagttctctcctgaagaatgatattcccatgacaggtccattagtggctggagggctccttacagtatgttacgtgctcactggacgatcggccgatttggaactagagagagcggccgatgtaaaatgggaagatcaggcagaaatatcaggaagcagcccaatcctgtcaataacaatatcagaagatggcagcatgtcgataagaaatgaagaggaagaacaaacactgaccatactcatcagaacgggattgttggtgatctcaggagtctttccagtatcgataccagttacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctagtatcatatggaggaggctggaagctagaaggagaatggaaggaaggagaggaagtccaagtcctggcattagaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagaaatcgaagatgacattttccgaaagaaaagattgaccatcatggaccttcatccaggagcaggaaagacaaaaagataccttccagccatagttagagaagccataaaacgtggcttgagaacattaatcctggctcccaccagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggattttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgacgaagactgtgcacattggaaagaagccaaaatgctcctagataacatcaacacacccgaaggaatcattcctagtatgttcgaaccagagcgtgaaaaagtggatgccattgatggtgaataccgtttgagaggagaagcaaggaaaaccttcgtggacctaatgagaagaggggacttaccagtctggttagcctacaaagtggcagctgaaggcatcaactacgcagacagaaggtggtgttttgatggaatcaagaataaccaaatactggaagaaaatgtggaagtggaaatctggacaaaagaaggggaaaggaaaaaattaaaacccagatggttggatgctaggatctattctgacccactggcactaaaagaattcaaggaatttgcagccgggagaaaatctttgaccctgaatttaatcacagaaatgggtaggcttccaactttcatgactcagaaggcaagaaacgcactggacaacttggctgtgctgcatacggctgaggcaggtggaaaggcgtataatcatgctctcagtgaactgccggagaccctggagacactgcttctactaacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtggccacaacatttgtcacaccaatgttgaggcatagcattgaaaattcctcagtgaatgtctccctaacagccattgctaaccaagctacagtgctaatgggtcttgggaaaggatggccattgtcaaagatggacatcggagttcccctcctcgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccctggcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacctatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaatccatatatgccctcagtcatagaaaaaatggaaacactacaaaggaaatatggaggagccttagtgaggaatccactctcacgaaactccacgcatgagatgtactgggtatctaatgccactgggaacatagtgtcatcagtgaacatgatttcaaggatgttgattaacagattcacaatgaaacacaagaaagccacctacgagccggatgttgacctgggaagtggaactcgcaacattggaattgaaagtgagataccaaatctagacataataggaaagagaatagagaaaataaagcaagagcatgaaacatcatggcactatgaccaagaccacccatacaaaacgtgggcttaccatggcagctatgagacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaacccaagaaccgaaggaaggcacaaagaaactgatgaaaattacggcagagtggctttggaaagaactaggaaagaaaaagacacccaggatgtgtaccagagaagaattcacaagaaaggtgagaagcaatgcagccttgggggccatattcactgatgagaacaaatggaaatcggcacgtgaggctgttgaagatggtaggttttgggagctggttgacagggaaagaaatctccatcttgaaggaaagtgtgagacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaagctagccgaggccatattcaaattaacgtaccaaaacaaagtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagtcacagaagaaatcgctgtacagaactggctagcaagagtggggcgtgaaaggctatcaagaatggccatcagtggagatgattgtgttgtaaaacccatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccaaggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacgagtcgaacaacctggtccatacacgctaagcatgaatggatgacgacggaggacatgctggcagtctggaacagggtgtggatccaagaaaacccgtggatggaagacaaaactccagtggaatcatgggaagaagtcccatacttggggaaaagagaagaccaatggtgtggctcattgattgggctaacaagcagggctacctgggcaaagaacatccaaacagcaataaaccaagtcagatcccttataggcaatgaggaatacacagactacatgccatccatgaagagattcagaagggaagaggaagaggcaggtgtcctgtggtag

SEQ ID NO: 761 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctattaatgttttgagagggttcaggaaagagattggaaggatgctgaacatcttgaacaggagacgcaggacagcaggcgtgattgttatgttgattccaacagtgatggcgttccatttaaccacacgcaatggagaaccacacatgatcgttggtaggcaggagaaagggaaaagtcttctgttcaaaacagaggatggtattaacatgtgtaccctcatggccatagaccttggtgaattgtgtgaagatacaatcacgtacaagtgtcctctcctcaaacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccatagggacgacacatttccaaagggccttgattttcatcttactgacagctgtcgctccttcaatgacaatgcgctgcataggaatatcaaatagagacttcgtagaaggggtctcaggaggaagctgggttgacatagtcttagaacatggaagttgtgtgacgacgatggcaaaaaacaaaccaacattggattttgaactgataaaaacagaagccaaacaacctgccactttaaggaagtactgtatagaagcaaagctgaccaacacaacaacagaatcgcgttgcccaacacaaggggaacccagtctaaatgaagagcaggacaaaaggttcatctgcaaacattccatggtagacagaggatggggaaatggatgtggattatttggaaagggaggcattgtgacctgtgctatgtttacatgcaaaaagaacatggaaggaaaagtcgtacagccagaaaatttggaatacaccatcgtgataacacctcactcaggagaagaacacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaagctacagctcaaaggaatgtcatactctatgtgtacaggaaaatttaaaattgtgaaggaaatagcagaaacacaacatggaacaatagttatcagagtacaatatgaaggagacggttctccatgtaagatcccttttgagataacagacttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggattttggatccctgggaggggtgtttacatctataggaaaggctctccaccaagtttttggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacggtccttgcggccccagcccactgagctgaagtactcttggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgcattttgtgactcaaaactcatgtcagcggccattaaagacaacagagccgtccatgccgatatgggttattggatagaaagtgcactcaatgacacatggaagatggagaaagcctcattcattgaagttaaaagctgccactggccaaagtcacacaccctctggagcaatggagtattagaaagtgagatgataattccaaaaaattttgccgggccagtgtcacaacacaaccacagaccaggttaccacacacaaacagcaggaccttggcatctaggtaagcttgagatggactttgatttctgcgaaggaaccacagtggtggtgactgaggactgtggaaatagaggaccctctttaagaacgaccactgcctccggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggcatgggagtgacttatcttgccctactagcagctttcaaagttagaccaacttttgcagctggactactcttgagaaaactgacctccaaggaattaatgatggccaccataggaattgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctctcgagaaccagcaagaaaaggagctggccgctaaatgaagctatcatggcagtcgggatggtgagcattttagccagttctctcctaaagaatgatattcccatgacaggtccactagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggactgttggtgatctcaggagtctttccagtatcgataccaattacggcagcagcatggtacctgtgggaagtgaagaaacaacgggccggagtattgtgggacgtcccttcacccccaccagtgggaaaagccgaactggaagatggagcctatagaatcaagcaaagagggtttcttggatattctcagattggagccggagtttacaaagaaggaacattccatacaatgtggcacgtcacacgtggtgctgttcttatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacactggaaccataggcgccgtatctttggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggactttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggattttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagccaaaatgctcctagataacatcaacacacccgaaggaatcattcctagtatgtttgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaatgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacacagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttgttggtagcacattatgccattatagggccaggacttcaagcaaaagcaaccagagaagcacagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggccttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatttacaagaaaagtggaatccaggaagtggatagaaccctagcaaaagaaggcataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctggtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacattgcaaaggaaatatggaggagccttggtgaggaatccactctcacgaaactccacgcatgaaatgtactgggtatctaatgccaccggtaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaacccaagaaccgaaggaaggcacaaagaaactgatgaaaattacggcagagtggctttggaaagaactaggaaagaaaaagacacctagggtgtgtaccagagaagaattcacaagaaaagtgagaagcaatgcagccttgggggccattttcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaaaaaggaagggggagcaatgtacgccgatgatacagcaggatgggacacaagaatcacactagaagatttaaagaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtggacaagtcggcacctatggccttaatacttttaccaatatggaagcccaattaattagacagatggagggagaaggaatcttcaaaagcattcagcacctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttagggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataagtcaagtcagatctcttataggcaatgaggaatacacagactacatgccatccatgaagagattcagaagggaagaggaagaggcaggtgtcctgtggtag

SEQ ID NO: 762 - DNA, 10176 bp, Dengue virus
atgaataaccaacggaaaaaggcgagaaatacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgttttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgctggtgcaactctacgtccacatgggtaacttatgggacatgtaccaccacaggagaacacagaagagaaaaaagatcagtggcactcgttccacatgtaggcatgggactggagacacgaactgaaacatggatgtcatcagaaggggcctggaaacatgttcagagaatcgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacgcaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggctacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagtccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggccctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgttaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagccagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgttgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttctcagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 763 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaattaaaaaatcaaaagccattaatgttttgagagggttcaggaaagagatcggaaggatgctgaacatcttgaataggaggcgcaggtctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagttttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcattagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggattcgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataatcaaacttttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtgaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactctttggtcacagccggacatgggcaggttgacaatttttcactgggagtcttgggaatggcattgttcttggaggaaatgcttaggacccgagtaggaacgaaacatgcaatactactagttgcagtttcttttgtgacattgatcacagggaacatgtccttcaaagacctaggaagagtggtggttatggtaggcgctacaatgacggatgacataggtatgggcgtgacttatcttgccctactagcagccttcaaagttagaccaacttttgcagctgggctactcttgagaaagctgacctccaaggaattgatgatgactaccataggaattgtactcctctcccaaagtgctataccagagaccgtgcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaactaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcattaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcggaaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagccacagggcccatctccacactgtgggaaggaaacccaggaaggttctggaacactaccatagcggtgtcaatggctaacatctttagagggagttacttggctggagctggacttctcttttccattatgaagaacacaaccaatacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgtacactcagagtccttaatttagtagaaaattggttgaacaacaacactcaattttgcataaaagttctcaatccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagagaagaagctaggggaattcggcaaggcaaaaggcagcagagccatatggtacatgtggcttggagctcgcttcctggagtttgaagccctaggattcctaaatgaagaccactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgaaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaatgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaagaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacgcagattacatgccatccatgaaaagattcagaagagaagaggaagaagcaggagtcctgtggtaa

SEQ ID NO: 764 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaattaaaaaatcaaaagccattaatgttttgagagggttcaggaaagagatcggaaggatgctgaacatcttgaataggagacgcaggtctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacaggagcagaattgacaggttatggcaccgtcacgatggagtgctccccgagaacaggcctcgacttcaatgagatggtgttgctgcagatggaaaataaagcttggctggtccataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaactatagtcatcagagtgcaatatgaaggggacggctctccatgtaaaatcccttttgaaataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcgtcacagacaatgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattttagcagaaaatgaggtgaagttgactattatgacaggagacattaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggttttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacactaccacccctaagatacagaggtgaggatgggtgctggtacgggatggaaatcagaccattgaaagagaaagaagaaaatctggttaactccttggtcacagccggacatgggcaggttgacaatttttcactgggagtcctgggaatggcattgttcttggaggaaatgcttaggacccgagtaggaacgaaacatgcaatactactagttgcagtttcttttgtgacactgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttctgacatcctcacagcaaaaaacggattggataccattagcattgacaatcaagggtctcaatccaacagctatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggtgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctgggaaaaatccaagagccgtccaaacaaaacctggtcttttcaaaaccagcaccggaacaataggtgccgtatctctggacttttcccctggaacgtcaggatctccaattatcgacaaaaaaggaaaagttgtgggtctttatggtaatggtgttgtcacaaggagtggagcatatgtaagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcacatttcacagacccagcaagtatagcagctagaggatacatctcaacccgagtggaaatgggtgaggcagctgggattttcatgacagccactcccccgggaagcagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactaaaaccaatgactgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaatatcgtttgagaggagaagcaaggaaaacctttgtggacttaatgaggagaggagacttaccagtctggttggcttacaaagtggcagctgaaggcatcaactatgcagacagaaggtggtgttttgatgggattaagaacaaccaaatcctggaagaaaatgtggaagttgaaatctggacaaaagaaggggaaaggaagaaattgaaacccagatggttggatgccaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggaggaatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgtcacaccaatgctgagacatagcattgagaattcctcagtgaatgtatccctaacagctatagccaaccaagcaacagtgttaatgggtctagggaagggatggccattgtcaaagatggacatcggagttccccttctcgccattggatgttactcacaagtcaatcccataactctcacagcagctctcctcttattggtagcgcattacgccatcatagggccaggacttcaagcaaaagcaaccagagaagcccagaaaagagcagcggcgggcatcatgaaaaatccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccatcgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagacctacaagaaaagtggaatccaggaagtggatagaaccttagcaaaagaaggcatcaaaagaggagaaacggaccatcacgctgtgtcgcgaggctcggcaaaactgagatggttcgttgagagaaacatggtcacaccagaagggaaagtagtggacctcggttgtggcagaggaggctggtcatactattgcggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctggaaacatagtgtcatcggtgaacatgatttcaaggatgttgatcaatagattcacaatgagacacaagaaagccacttacgagccggatgttgacctcggaagcggaacccgaaacattggaaatgaaagtgaaataccaaacctagacataattgggaaaagaatagaaaaaataaagcaagagcatgaaacatcatggcactacgaccaagaccacccatacaaaacgtgggcatatcatggtagctatgaaacaaaacagactggatcagcatcatccatggtcaatggagtggtcaggctgctgacaaaaccttgggacgtcctccctacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaagctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccagagaggtagtgggcaagttggcacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgactgtgttgtgaaacctttagacgacaggttcgcaaacgctttgacagccctaaatgacatgggaaagattagaaaagatatacaacaatgggaaccttcaaaaggatggaacgattggacacaagtgcccttctgttcacaccatttccatgagctaatcatgaaggatggtcgtgtgcttgttgttccatgtagaaaccaagatgaactgattggcagagcccgaatctcccaaggagcagggtggtctttgcgggagacggcttgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgtggctcattgattgggttaacaagcagggccacatgggcaaagaacatccaagtagcaataaatcaggttagatctcttataggcaatgaggaatacacagattacatgccatccatgaaaagattcagaagagaagaggaagaagcaggagtcctgtggtaa

SEQ ID NO: 765 - DNA, 10176 bp, Dengue virus
atgaataaccaacggaaaaaggcgagaagtacgcctttcaatatgctgaaacgcgagagaaaccgcgtgtcaactgtgcaacagctgactaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagtaatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgccccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggctctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagatctgccgttaccatggctacccggagcggacacacaaggatcaaattggatacagaaagagacgttggtcactttcaaaaatccccacgcgaagaaacaggacgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtgcaatatgaaggggacggctctccatgtaagattccttttgagataatggatttggaaaaaagacacgtcctaggtcgcctgattacagtgaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttttccacaaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcgcacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgtgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctactatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggtttgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcttatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgccatagcccagaccgaaaaaagcattgaagacaatccagagatcgaagatgacattttccgaaagaaaagattgaccatcatggatctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagctcacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatcgggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgctgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcgtcagtgaacatgatttcaaggatgttgattaacagattcacaatgaagcacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagagatcgctgtgcagaactggttagcaagagtggggcgtgaaaggttatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttaggaaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 766 - DNA, 10176 bp, Dengue virus
atgaataaccaacggaaaaaggcgagaagtacgcctttcaatatgctgaaacgcgagagaaaccgcgtgtcaactgtgcaacagctgactaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagtaatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgccccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggctctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacactatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagatctgccgttaccatggctacccggagcggacacacaaggatcaaattggatacagaaagagacgttggtcactttcaaaaatccccacgcgaagaaacaggacgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagtgaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttttccacaaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcgcacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgtgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctactatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggtttgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcttatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgccatagcccagaccgaaaaaagcattgaagacaatccagagatcgaagatgacattttccgaaagaaaagattgaccatcatggatctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagctcacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaacttagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatcgggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtggtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccaccagaaaagtgtgacacattgctgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaagcacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagagatcgctgtgcagaactggttagcaagagtggggcgtgaaaggttatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 767 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgctgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctaaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 768 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagaaccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacttttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagtccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcttggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagatatcttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggagccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacacagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttctatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccaccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacccaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgagtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 769 - DNA, 10176 bp, Dengue virus
atgaataaccaacggaaaaaggcgagaaatacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgttttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgctggtgcaactctacgtccacatgggtaacttatgggacatgtaccaccacaggagaacacagaagagaaaaaagatcagtggcactcgttccacatgtaggcatgggactggagacacgaactgaaacatggatgtcatcagaaggggcctggaaacatgttcagagaattgaaacctggatcttgagacatccaggcttcaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacgcaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacatcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatcccctccaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcagggaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgacgtaaaatgggaagatcaggcagaaatatcaggaagcagcccaatcctgtcaataacaatatcagaagatggcagcatgtcgataaaaaatgaagaggaagaacatacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgttaagaaagacctaatatcatatggaggaggctggaagctagaaggagaatggaaagaaggagaggaagtccaagtcttggcattggaacctggaaaaaatccaagagccgtccaaacgaaacctggacttttcaagaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagccagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggttacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagtggaaaaggtatagggaaaatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaacctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacgttggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagctagtcatgaaagatggccgcgtgctcgtggtcccatgcagaaaccaagatgaactgattggtagagcccgaatctctcagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 770 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcattccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatttaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaattgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataaccctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagacgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcgcattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 771 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatggaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttgctgacagctgtcgctccttcaatgacaatgcgttgtataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccaccctaaggaagtactgtatagaagcaaagctgaccaatacaacaacagaatctcgctgcccaacacaaggggaacccagtctaaatgaagagcaggacaaaaggttcctctgcaaacactccatggtagacagaggatggggaaatggatgtggattatttggaaagggaggcattgtgacctgtgctatgtttacatgtaaaaagaacatggaaggaaaagtcgtgcagccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggttactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcttcataggagtcatcatcacatggataggaatgaattcacgtagcacctcactgtctgtgtcactagtgttggtgggagtcgtgacactgtacctgggagctatggtgcaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagattatggttttggagtttttaccaccaatatatggctaaaattgagagaaaaacaggatgtattttgtgactcaaaactcatgtcagccgccataaaagacaacagagccgtccatgccgatatgggttattggatagaaagtgcactcaatgacacatggaagatggagaaagcctctttcattgaagttaaaagctgtcactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgcagatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttccccactgctcttaacatcctcacagcagaaagcggattggataccactggcattgacgataaaaggtctcaatccaacagccatttttctaacaaccctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccggtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaggaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagctatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatctcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagtagaaagacttttgactctgagtatgttaagactagagccaatgattgggactttgtggtcacaactgacatttcagaaatgggtgccaacttcaaggctgagagggttatagaccccagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtatatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgtttaagaggagaagcaaggaaaacctttgtggatctaatgagaagaggggacttaccagtctggttggcctacagagtggcagctgaaggcatcaactacgcagacagaaggtggtgttttgatggaatcaagaacaaccaaatactggaagaaaacgtggaagtggaaatctggacaaaagaaggggaaaggaagaaattaaaacccagatggttggatgctagaatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaaaggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaagaatctgagagcaacatcctggacatagatctacgtcctgcatcagcatggacgctgtatgccgtggctacaacatttgtcacaccaatgctgagacatagcattgaaaattcctcagtgaatgtctccctaacagccattgctaaccaagccacagtgctaatgggtcttgggaaaggatggccattgtcaaagatggacatcggagttcccctccttgccattggatgctactcacaagtcaaccctataactctcacagcagctcttcttttgttggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgagaagcagttaggacaagtaatgctcctaatcctctgcgtgactcaagtactaatgatgaggactacatgggctctgtgtgaggctctaaccttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacgtcatggcactatgaccaagaccacccatacaaaacgtgggcttaccatggcagttatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctagaatgtgtactagagaagaattcacaagaaaggtgagaagcaatgcagccttgggagccatattcactgatgagaacaaatggaagtcggcacgtgaggctgttgaagatagtaggttttgggagctggttgacagggaaagaaatctccatcttgaaggaaagtgtgaaacatgtgtgtacaacatgatgggcaaaagagagaagaaactaggggagttcggcaaggcaaaaggtagcagagccatatggtacatgtggcttggagcacgcttcttagagtttgaagccctaggattcttgaatgaagaccactggttctccagagggaactccctgagtggagtggaaggagaagggctgcataggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaacactttcaccaacatggaagcccaattaattagacagatggaaggagaaggaatcttcaagagcattcagcacttgacagttacagaagaaatcgctgtacagaactggttagcaagagtgggacgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 772 - DNA, 10176 bp, Dengue virus
atgaacaaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacaacagggatactgaaaagatggggaacgatcaaaaaatcaaaagctatcaatgttctgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggtagacatagtcttagaacatggaagttgtgtgacgacgatggcaaaaaataaaccaacattggattttgaactgataaaaacagaagccaaacagcctgccactctaaggaagtactgtatagaagcaaagctgaccaatacaaccacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagctgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaggacaacagagccgtccatgccgatatgggttattggatagaaagtgcactcaatgacacatggaagatggagaaagcctctttcattgaagttaaaagctgccactggccaaagtcacacactctctggagcaatggagtattggaaagtgagatgataattccaaaaaattttgctgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacagatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgacttggaactggagagagctgccgatgtaaaatgggaagatcaggcagaaatatcaggaagcagcccaatcctgtcaataacaatatcagaagatggcagcatgtcgataaaaaatgaagaggaagaacaaacactgactatactcatcagaacgggattgttggtgatctcaggagtctttccagtatcgataccaatcacggcagcagcatggtatttgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctgggaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgacgctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctcttagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtagccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatttttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgatcaacagattcacaatgaaacacaagaaagccacctacgagccagatgttgatctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgttgtccctatggtgacacagatggcaatgacagacacgactccatttggacaacaacgcgttttcaaagagaaagtggacacgagaacccaagaaccgaaggaaggcacaaagaaattgatgaaaattacggcagaatggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgtttcttagagtttgaagccctaggattcttgaatgaagatcactggttctccagagggaactccctgagtggagtggaaggagaagggctgcacagactaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtatttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattaattgggctaacaagcagggctacctgggctaagaacatccaaacagcaataaatcaagtcagatcccttataggcaatgaggaatacacagactacatgccatctatgaagagattcagaagggaagaggaagaggccggtgtcctgtggtag

SEQ ID NO: 773 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatagcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggaggcattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatggtaattccaaaaaattttgccggaccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgacgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagttgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacaaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagaaatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggcttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacagtaacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagaaaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggaaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaaatcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 774 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaggggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggaaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacacctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctaattacagttaacccaatcgtaacagaaaaagatagcccagtcaacatagaagcagaacctccattcggagacagctacatcatcataggagtagagccgggacaattgaaactcaattggttcaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcggacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggtaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaactttcgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaagaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgactctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgttgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaaaaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 775 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcaaacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacatacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgcacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcacgagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 776 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagagacaatcacgtacaagtgtcctctcctcagacaaaatgaaccagaagacatagattgttggtgcaactctacgtccacatgggtaacttatgggacatgtaccaccacaggagaacatagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcgaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggaatacaccatcgtgataacaccccactcaggagaagagcacgctgtaggtaatgacacaggaaagcatggcaaagaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgatcacagttaacccaatcgtaacagaaaaagatagcccagtcaacatagaagcagaacctccattcggagacagctatatcatcataggagtagagccgggacaattgaaactcaattggtttaagaagggaagttctatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgtagtgagttggaaaaataaagaactgaaatgtggcagcgggatcttcatcacagataacgtacacacatggacagaacaatataagtttcaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgaactgaagtactcatggaaaacatggggaaaggcgaaaatgctctccacagagtctcacaatcagacctttcttattgatggccctgagacagcagaatgccccaacacaaacagagcttggaattcgctggaagttgaagactatggttttggagttttcaccaccaatatatggctgaaattgagagaaaaacaggatgtattttgtgattcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtaactgaggactgtggaaatagaggaccctctttgagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgaataggaacgaaacatgcaatactgctagttgcagtatcttttgtgacattgataactgggaacatgtcttttagagacctgggaagagtgatggttatggtgggcgctaccatgacggatgacataggtatgggagtgacttatcttgccctactagcagcttttaaagttagaccgacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagccggagtctacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacatcttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcccccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacctttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaacgaaaatgaccagtacatatacatgggggaacctcttgaaaatgatgaagactgtgcacattggaaagaagctaaaatgctcctagataacatcaatacacccgaaggaatcattcctagtatgttcgaaccagagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgacccagaaagcaagaaacgcactggacaacttggctgtgctgcatacggctgaggcaggtggaagggcgtacaatcatgctctcagtgaactgccggagaccctggagacactgcttttactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgccaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccattatgaaaaacacaacaagcacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgatgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgatcaacagattcacaatgaaacacaagaaaaccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaatcttcaaaagcattcagcacctgacagccacagaagaaattgttgtacagaattggttggcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 777 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaggggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaaaggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagtagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggctatgcacacggcactcacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctaattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagttggaaaagtagagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcggacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtgttggaaagtgagatgataattccaaaaaattttgccgggccagtgtcacaacacaactacagaccaggctaccacacacaaacagcaggaccttggcatctaggtaagcttgagatggactttgatttctgcgaaggtaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtaaactccttggttacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaactttcgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagagtggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattataacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgttgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagatagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggcgtcctgtggtag

SEQ ID NO: 778 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggtgtgattattatgttgattccaacagcgatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacaggagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaaggtcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcgttacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagatattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgtacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgttacacgtggtgctgttctgatgcatagagggaagaggattgaaccatcatgggcagacgtcaagaaagacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagccgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaatctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttagatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataaccctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaatactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgaaagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaacaacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggtagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagaccactggttctccagagggaactccctgagtggagtggaaggagaagggctgcacaggctaggctacatcttaagagacgtgagcaagaaggaagggggagcaatgtacgccgatgatacagcagggtgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 779 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcctctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcatatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggggccatggtgcaggctgatagtggttgcgttgtgagctggaaaaataaagaactgaaatgtggcagcgggatcttcattacagacaacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgagctggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaaaacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggccacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaggggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctggtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatacatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaagtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaattttcaaaagcatccagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 780 - DNA, 10176 bp, Dengue virus
atgaacaaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacgcagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcctctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggagccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagcccatgaagagggcatttgcggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagtaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggatttttatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgactctgagtatgtcaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccattgatggtgaataccgtttgagaggagaagcaaggaaaacctttgtagacctaatgagaagaggggacttaccagtctggttggcttacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtataatcatgctctcagtgaactgccggagaccctggagacactgcttttactgacactcctggccacagtcacaggaggaatcttcttattcttaatgagcggaaaaggtatagggaaaatgaccctgggaatgtgttgcataatcacggctagcatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtccttaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgaccttagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggtaatgaggaatacacagactacatgccatccatgaagagattcagaagggaagaggaagaggctggtgtcctgtggtag

SEQ ID NO: 781 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaggcaaagctgaccaatacaacaacagaatctcgttgcccaacacaaggggaacccagtctaaatgaagagcaggacaaaaggttcctctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtactggtgggagtcgtgacactgtacctgggagctatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatatagaggtgaggatggatgctggtacgggatggaaatcagaccattgaaagagaaagaggagaatttggtcaactccttggtcacagccggacatgggcagattgacaacttttcactaggaatcttaggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtcttaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaagaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagtcagagaagccataaaacgtggcttgagaacattaatcctggctcctactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgacccagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacattggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcttcagcatggacgctgtatgccgtggccacaacatttgtcacaccaatgttgagacatagcattgaaaattcctcagtgaatgtctccctaacagctattgctaaccaagccacagtgctaatgggtcttgggaaaggatggccattgtcaaagatggacattggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgacggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagaaaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctttaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagggaagaccaatggtgcggctcattgattgggctaacaagcagggctacctgggcaaagaacatccaaacagcaataaatcaagtcagatcccttataggcaatgaggaatacacagactacatgccatccatgaagagattcagaagagaagaggaagaggcaggtgtcctgtggtag

SEQ ID NO: 782 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtatgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaactaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggtaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagatgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggcctcaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttaaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttgggaaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 783 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgaaccatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgtttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctactatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagcatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcactacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcaacagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 784 - DNA, 10176 bp, Dengue virus; identical to SEQ ID NO: 772

SEQ ID NO: 785 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacatacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactcagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 786 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 787 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtgccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaattacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatattggagttttttcttatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccctgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaaattagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 788 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattgaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaagtgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtcttaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaatctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaattacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaaaatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaactaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccagttttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaaattagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 789 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattgaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagacaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaagtgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttaggttctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtcttaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaattacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaactaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccagttttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaaattagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 790 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagacacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagtcatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcgaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgaccatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacctggctgtgctgcatacggctgaggcaggtggaagggcatacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctctctaacagccattgctaaccaagccacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaagagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 791 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgttgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagatagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgtgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaagcaggatgtattttgtgactcaaaactcatgtcagcggccattaaagacaacagagccgttcatgctgatatgggttattggatagaaagtgcactcaatgatacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcggcttttaaagttagaccaacttttgcagctggactactcttaagaaaactgacctccaaggaattgatgatggccaccataggaatcgcactcctttcccaaagcaccataccagagaacattcttgaactgactgatgcattagccctgggcatgatggtcctcaagatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgagaaccagcaagaaaaggagctggccgctaaatgaagctatcatggcagttgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagggacccatttcctcagagcaatgcaccaatcatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacttaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttcttttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttgaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcaacacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 792 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgttacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatacggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctagaatctattctgacccactggcactaaaagaattcaaggaatttgcagctggaagaaaatctttgaccctgaacctaatcacagaaatgggtaggcttccaactttcatgactcagaaagcaagaaacgcactggacaacctggctgtgctgcatacggctgaggcaggtggaagggcgtacaatcatgctctcagtgaactgccggagaccttggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaatgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaatggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcaatgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 793 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacggactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaaatcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtacgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcgagaaacgcactggacaacttggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgactaaacgcattggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcagagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagaaaccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagctgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 794 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgcaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcctagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagaggagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacatttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatcttcatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgtgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgctatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacattcaaacagcaataaatcaagtcagatcccttataggcaatgaggaatacacagactacatgccatccatgaagagatttagaagggaagaggaagaggcaggtgtcctgtggtag

SEQ ID NO: 795 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatttctgcgaaggaaccacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaagcagcaataaatcaagtcagatcccttataggcaatgaggaatacacagactacatgccatccatgaagagattcagaagggaagaggaagaggcaggtgtcctgtggtag

SEQ ID NO: 796 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatggaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtactggtgggcgttgtgacactgtacctgggagctatggtgcaagctgatagtggttgcgttgtgagctggaaaaataaagaactgaaatgtggcagcgggatcttcatcacagataacatacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttaaccattatgacaggagacatcagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggctattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagctgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccggagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacatgggcttaccatggcagctatgaaacaaaacaaactggatcagcatcatctatggtgaacggagtggtcagattgctgacaaaaccctgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggcctcaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgactgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagttagatcccttataggcaatgaggaatacacagactacatgccatccatgaagagatttagaagggaagaggaagaggcaggtgtcctgtggtag

SEQ ID NO: 797 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatggaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattaaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtactggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacatcagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggctattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagctgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtagcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaaaaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccctgggacgtcgtccctatggtgacacagatggcaatgacagacacgactccttttggacaacagcgcgtcttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggcctcaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgtagtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgtggctcattgattgggctaacaagcagggctacctgggcaaagaacatccaaacagcaataaatcaagttagatcccttataggcaatgaggaatacacagactacatgccatccatgaagagatttagaagggaagaggaagaggcaggtgtcctgtggtag

SEQ ID NO: 798 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaatatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacctgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactagcactaaaagaattcaaggaatttgcagctggaagaaaatctttgaccctgaacctaatcacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtagctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggggcaatgtacgccgatgatacagcaggatgggacacaagaatcacactagaagacttaaaaaatgaagaaatggtaacgaaccacatgaaaggagaacacaagaaactagccgaggccatattcaaactaacgtaccaaaacaaggtggtgcgtgtgcaaagaccaacaccaagaggtacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 799 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacatagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcgaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggaatacaccatcgtgataacaccccactcaggagaagagcacgctgtaggtaatgacacaggaaagcatggcaaagaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggtttctagacctgccgttaccatggctacccggagcagacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgatcacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgtagtgagttggaaaaataaagaactgaaatgtggcagcgggatcttcatcacagataacgtacacacatggacagaacaatataagtttcaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgaactgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttcaccaccaatatatggctgaaattgagagaaaaacaggatgtattttgtgattcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtaactgaggactgtggaaatagaggaccctctttgagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgaataggaacgaaacatgcaatactgttagttgcagtatcttttgtgacattgataactgggaacatgtcttttagagacctgggaagagtgatggttatggtgggcgctaccatgacggatgacataggtatgggagtgacttatcttgccctactagcagcttttaaagttagaccgacttttgcagctggactactcttgagaaaattgacctccaaggaattgatgatggccactataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagccggagtctacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacatcttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcccccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacctttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaacgaaaatgaccagtacatatacatgggggaacctcttgaaaatgatgaagactgtgcacattggaaagaagctaaaatgctcctagataacatcaatacacccgaaggaatcattcctagtatgttcgaaccagagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagatagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgacccagaaagcaagaaacgcactggacaacttggctgtgctacatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctactacatttgtcacaccaatgttgagacatagcattgaaaattcctcagtgaatgtctccctaacagccattgccaatcaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccattatgaaaaacacaacaagtacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgatgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgatcaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccgtacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagtttggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaatcttcaaaagcattcagcacctgacagccacagaagaaattgttgtacagaactggttggcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagtagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 800 - DNA, 10176 bp, Dengue virus
atgaataaccaacggaaaaaggcgagaagtacgcctttcaatatgctgaaacgcgagagaaaccgcgtgtcaactgtgcaacagctgactaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagtaatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgccccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggctctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacactatcgtgataacacctcactcaggagaagagcacgctgtaggtaatgacacaggaaaacatggcaaggaaattaaaataacaccacagagctccatcacagaagcagaactgacaggctatggcactgtcacgatggagtgctctccgagaacgggcctcgacttcaatgagatggtgctgctgcagatggaagacaaagcctggctggtgcacaggcaatggttcctagatctgccgttaccatggctacccggagcggacacacaaggatcaaattggatacagaaagagacgttggtcactttcaaaaatccccacgcgaagaaacaggacgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagtgaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttttccacaaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcgcacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgtgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctactatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcagattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggtttgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcttatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgccatagcccagaccgaaaaaagcattgaagacaatccagagatcgaagatgacattttccgaaagaaaagattgaccatcatggatctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagctcacttcacggacccagcaagtatagcagctagaggatatatctcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatcgggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgctgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaagcacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttgaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagagatcgctgtgcagaactggttagcaagagtggggcgtgaaaggttatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 801 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcaatggcattccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgtccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgataacttttcactaggagtcttgggaatggctctgttcctggaagaaatgctcaggacccgagtaggaacgaaacatgcaatactgctagtggcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggattactcttgagaaaactgacctccaaggaactaatgatggccaccataggaatcgcactcctttcccaaagcaccataccagagactattcttgaactgactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttaccgtgtgttacgtgctcactggacgatcggccgatttggaactggagagagctgccgatgtaaaatgggaagatcaggcagaaatatcaggaagcagtccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgtcctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctacgtagtcatagccatcctcacagtggtggccgcaaccatggcaaatgagatgggtttcctggaaaaaaccaagaaagacctcggactgggaagcattataacccaggaatctgagagcaacatcctggacatagatttacgtcctgcatcagcatggacgctgtatgccgtggccacaacatttgttacaccaatgttgagacatagcatcgaaaattcctcagtgaatgtctccctaacagccattgctaaccaggccacagtgctaatgggtcttgggagaggatggccattgtcaaagatggacatcggagttcccctccttgccattggatgctattcacaagtcaaccctataactctcacagcagcccttcttttgctggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggaccttggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctgggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactaatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcggacaagtcggcacctatggccttaatactttcaccaacatggaagcccaattaattagacagatggagggagaaggaatttttaaaagcattcagcacctgacagtcacagaagaaatcgctgtacagaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaagccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccatggatggaagacaaaactctagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 802 - DNA, 10176 bp, Dengue virus
atgaataaccaacgaaaaaaggcgagaagtacgcctttcaatatgctgaaacgcgagagaaaccgcgtgtcaactgtgcaacagctgacgaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaaatcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactccatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggttaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttaaagacctgggaagagtgatggttatgatgggcgctaccatgacggatgacataggtatgggagtgacttatcttgccctactagctgcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaagatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatacgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagcataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaattacagaaatgggtaggcttccaactttcatgacccagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggcatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttatcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaactctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatttagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcatccagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaaattagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 803 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctttcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttttgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaaaaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagttcaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatttacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 804 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcactcgttccacatgtgggtatgggactagagacacgaactgaaacatggatgtcatcagaaggggcctggaaacatgttcagagaattgaaacctggatcctgagacatccaggctttaccataatggcagcaatcctggcatacaccataggaacaacacatttccaaagggccttgattttcatcctactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaatgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggacgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctccccatgtaagatcccttttgagataatggatttggaaaaaagacacgtcttaggtcgcctgattacagttaacccaatcgtaacagaaaaagatagcccagtcaacatagaagcagaacccccattcggagacagctacattatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagaatctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaatttagccgggccagtgtcacaacacaattacagaccaggctaccacacacaaacagcaggaccttggcatctaggtaagcttgagatggactttgatttctgtgaaggaaccacagtggtggtgactgaggactgtggaaatagaggaccctctttaagaacgaccactgcctctggaaaactcgtaacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaggtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatacgtgagtgctatagcccagaccgaaaaaagcattgaagacaatccagagatcgaagatgacattttccgaaagaaaagattgaccatcatggacctccatccaggagcaggaaagacaaaaagatatcttccagccatagttagagaagccataaaacgtggcttgagaacattaatcctggctcccactagagtcgtggcagctgaaatggaggaagctcttagaggacttccaataagataccaaaccccagccattagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacccatgccagtgacccactctagtgcagcgcaaagaagagggagaataggaagaaatccaaaaaatgaaaatgaccagtacatatatatgggggaacccctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatccttgaccctgaacctaatcacagaaatgggtaggcttccaactttcatgactcagaaggcaagaaacgcactggacaatttagctgtgctgcatacggctgaggcaggtggaagggcgtacaatcatgctctcagtgaactgccggagaccctggagacactgcttttactgacactcctggccacagtcacaggaggaatctttttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctctctaacagctattgctaaccaagccacagtgctaatgggtcttgggaaaggatggccattgtcaaagatggacatcggagttcccctccttgccattggatgctactcacaagtcaaccctataaccctcacagcagcccttcttttattggtagcacattatgccattatagggccaggacttcaagcaaaagcaaccagagaagctcagaaaagagcagcagcaggtatcatgaaaaacccaacagttgatggaataacagtgattgacctagaaccaataccctacgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaatatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggatacgagaactcaagaaccgaaggaaggcacaaagaaactgatgaaaattacggcagagtggctttggaaagaactaggaaaggaaaagacacccaggatgtgtaccagagaagaatttacaagaaaggtgagaagcaatgcagccttgggggccatattcactgatgagaacaaatggaaatcggcacgcgaggctgttgaagatagtaggttttgggagctgattgacagggaaagaaatctccatcttgaaggaaagtgtgaaacatgtgtgtacaacatgatgggaaaaagagagaagaaactaggggagttcggtaaggcaaaaggtagcagagccatatggtacatgtggcttggagcacgcttcttagagtttgaagccctaggattcttgaatgaagatcactggttctccagagagaactccctgagtggagtggaaggagaggggctgcacaggctaggctacattttaagagacgtgagcaagaaggaagggggagcaatgtacgccgatgatacagcaggttgggacacaagaatcacactagaagacttaaaaaatgaagaaatggtaacaaaccacatgaaaggagaacacaagaaactagcagaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagccacagaagaaatcgctgtacagaactggttagcaagagtggggcgtgaaaggctatcaagaatggccatcagtggagatgattgtgttgtaaaacctttggatgacagatttgcaagtgccttaacagccctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaaatcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcttgtggtag

SEQ ID NO: 805 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattgaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaagtgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttaggttctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtcttaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaattacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaactaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccagttttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaaattagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 806 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttattgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaaacatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcacgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggttatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaacatggaagtggaaatctggacaaaagaaggggaaaggaaaaaattaaaacccagatggttggatgctaggatctattctgacccactggcactaaaagaattcaaggagtttgcagctggaagaaaatctttgaccctgaacctaatcacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgccaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacatcttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 807 - DNA, 10176 bp, Dengue virus; identical to SEQ ID NO: 806

SEQ ID NO: 808 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaataagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattgtttggaaagggaggcattgtgacctgtgctatgtttacatgcaaaaagaatatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagttgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttactggatagaaagtgcactcaatgacacatggaagatggagaaagcctccttcattgaagttaaaagctgctactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgagaaccagcaagaaaaggagctggccgctaaatgaagctatcatggcagttgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtaatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgctacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacattaacacacccgaaggaatcattcctagtatgttcgaaccagagcgtgaaaaagtggatgccattgatggtgaataccgtttgagaggagaagcaaggaaaacctttgtggacctaatgagaagaggggacttgccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccttgaacctaatcacagaaatgggtaggcttccaactttcatgactcagaaagcaagaaacgcactggacaacttggctgtgctgcacacggctgaggcaggtggaagggcgtacaatcatgctctcagtgaactgccggagaccctggagacactgcttctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaacgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgcttgtagtcccatgcagaaaccaagatgaacttattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 809 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatggaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagtcatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagtttttggagcaatctatggggctgcttttagtggggtctcatggactatgaaaatcctcataggagtcatcatcacatggataggaatgaattcacgtagcacctcactgtctgtttcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacatcagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggctattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgcttaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtagctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttacaatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacacagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaatgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaatacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccctgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggagagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagttagatcccttataggcaatgaggaatacacagactacatgccatccatgaagagatttagaagggaagaggaagaggcaggtgtcctgtggtag

SEQ ID NO: 810 - DNA, 10176 bp, Dengue virus; identical to SEQ ID NO: 809

SEQ ID NO: 811 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaactacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgccccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactaatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcatgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaagcagcaataaatcaagtcagatcccttataggcaatgaggaatacacagactacatgccatccatgaagagattcagaagggaagaggaagaggcaggtgtcctgtggtag

SEQ ID NO: 812 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgtttattatgttgattccaacagcaatggcgttccatttaaccacacgtaatggagaaccacacatgatcgttggtaggcaagagaaagggaaaagtcttctgttcaaaacagaggacggtgttaacatgtgtaccctcatggccatggaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatccataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgcggcagcgggatcttcatcacggataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgcagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgggcatgatggtcctcaaaatagtgagaaatatggagaagtaccaattggcagtgactatcatggctatctcgtgtgtcccaaatgcagtgatattgcaaaacgcatggaaggtgagttgcacaatattggcagcggtgtccgtttctccactgctcttgacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcagggagcagcccaatcctgtcaataacaatatcagaggatggcagcatgtcgataaaaaatgaagaggaagaacaaacactgactatactcatcagaacgggattgttggtgatctcaggagtctttccagtatcgataccaatcacggcagcagcatggtacttgtgggaagtgaagaaacaacgggctggagtattgtgggacgtcccttcacccccaccagtgggaaaggccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcggctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaaggaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagatctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacggctattgctaaccaagccacagtgctaatgggtcttgggaaaggatggccattgtcaaagatggacatcggagttcccctccttgccattggatgctactcacaagtcaaccctataactctcacagcagcccttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatctcaaggatgttgattaacagattcacaatgaaacacaagaaagccacctacgagccagatgttgacttaggaagcggcacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 813 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggatggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgatactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctactatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagcataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatttatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 814 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaattctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttctatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttgctgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggaccatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagaccattcttgaactgactgatgcgttagccttgggcatgatggtcctcaaaatagtgagaaatctggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagacggaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactatgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcatacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccatatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccgacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 815 - DNA, 10176 bp, Dengue virus
atgaacaaccaacgaaaaaaggcgagaagtacgcctttcaatatgctgaaacgcgagagaaaccgcgtgtcaactgtgcaacagttgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaagactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaatataggagagacacttggagaaaaatggaaaagccgattaaacgcactgggaaaaaatgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcataccagaagggaaggtggtggacctcggttgcggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttctttaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgatctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 816 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgcaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcctctgcaaacactccatggtagacagaggatggggaaatggatgtggattatttggaaagggaggcattgtgacctgtgctatgtttacatgcaaaaagaatatggaaggaaaagtcgtgcagccagaaaatttggaatacaccatcgtgataacacctcactcaggagaagagcacgctgtaggcaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtacaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaagtaacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattagaaagtgagatgataattccaaaaaattttgctgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacctatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgggttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcggaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaaaaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaggaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacactgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaaaggcgtacaatcatgctctcagtgaactgccggaaaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctggacatagatctacgtcctgcatcagcatggacgctgtatgccgtggccacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctactcacaagtcaaccctataacactcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattgatgatgaggactacatgggctctgtgtgaggctctaaccttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatacatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctagggagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaattcacaagaaaggtgagaagcaatgcagccttgggggccatattcactgatgagaacaaatggaaatcggcacgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggggcacgcttcttagagtttgaagccctaggattcttgaatgaagatcactggttctccagagggaactccctgagtggagtggaaggagaagggctgcacaggctaggctacattttaaaagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaggtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggtcatcagtggagatgattgtgttgtaaagcctttagatgacagatttgcaagtgctttaacagctctaaatgacatgggaaaagttaggaaagatatacaacaatgggaaccctcaagaggatggaacgattggacacaagtgcctttctgttcacaccattttcatgagttagtcatgaaagatggtcgcgtgctcgtagtcccgtgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacattcaaacagcaataaatcaagtcagatcccttataggcaatgaagaatacacagactacatgccatccatgaagagatttagaagggaagaggaagaggcaggtgtcctatggtag

SEQ ID NO: 817 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagaacaggacaaaaggttcctctgcaaacactccatggtggacagaggatggggaaatggatgtggattatttggaaagggaggcattgtgacctgtgctatgtttacatgcaaaaagaacatggaaggaaaagtcgtgctgccagaaaatttggaatataccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctttggaaaatgatgaagactgtgcacattggaaagaagctaaaatgcttctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgttgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaattctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaagggggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaacgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagcgtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 818 - DNA, 10176 bp, Dengue virus; identical to SEQ ID NO: 785

SEQ ID NO: 819 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtgttggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 820 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaaccaaaagctatcaatgttttgagagggttcaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagaaaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcacttgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggactttgaactgataaaaacagaagccaaacagcctgccactctaaggaagtactgtgtagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcggatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagaaccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaaatactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacggaatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgcagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgggcatgatggtcctcaaaatagtgagaaatatggagaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcggcatggtacttgtgggaagtgaagaaacaacgggctggagtattgtgggacgtcccttcacccccaccagtgggaaaggccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagctagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggactttgtggtcacaactgacatttcagaaatgggtgccaacttcaaggctgaaagggttatagaccccagacgttgcatgaaaccagtcatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgcttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaaggaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagatctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacggctattgctaaccaagccacagtactaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatctaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaaaacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtgacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 821 - DNA, 10176 bp, Dengue virus
atgaataaccaacggaaaaaggcgagaaatacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgaggcatccaggctttgccataatggcagcaatcttggcatacaccataggaacgacacatttccaaagggccttgattttcatcttactgacagctgtcgctccttcaatgacaatgcgttgcataggaatatcaaatagagactttgtagaaggggtttcaggtggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgtttacatgcaaaaagaacatggaaggaaaagtcgtgctgccggaaaatctggaatacaccatcgtgataacacctcactcaggagaagagcacgctgtaggcaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcactttcaaaaatccccacgcgaagaaacaggatgtcgtagttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaattgtaacagaaaaagatagcccagtcaacatagaagcagaacctccatttggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgcagcacctcactgtctgtgtcactagtattggtgggagtcgtgacactgtacctgggagctatggtgcaggctgatagtggttgcgttgtgagctggaaaaacaaagaactgaaatgtggcagcgggatcttcattacagataacgtgcacacatggacggaacaatataagttccaaccagaatccccttcaaaactagcttcagccatccaaaaagctcatgaagagggcatttgtggaatccgctcagtaacaagattggagaatctgatgtggaaacaaataacaccagaattgaatcacatcctatcagaaaatgaggtaaagttgaccattattacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgagacagcagaatgccccaacacaaacagagcttggaactcactggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcacttaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatatagaggtgaggatggatgctggtacgggatggaaatcagaccattaaaagagaaagaggagaatttggtcaactccttggtcacggccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttaccttgccctactagcagctttcaaagttagaccaactttcgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagttagaaacatggaaaagtaccaattggcagtgactatcatggctatctcgtgtgtcccaaatgcagtgatactgctaaacgcatggaaggtgagttgcacaatattggcagcggtgtccgtttctccattgctcttaacatcctcacagcagaaaacggattggataccactggcattgacgataaaaggtctcaatccaacagccatttttttaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttatgtgctcactggacgatcggccgatttggaactggagagagctgccgatgtaaaatgggaagatcaggcagaaatatcaggaagcagcccaatcctgtcagtaacaatatcagaagatggcagcatgtcgataaaaaatgaagaggaagaacaaacactgaccatactcattagaacgggattgctggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaactataggcgccgtatctctggacttttcccctggaacgtcaggatctccaattgtcgacagaaaaggaaaagttgtgggtctttacggcaatggtgttgtcacaaggagtggagcatatgtgagtgctatagcccagaccgaaaaaagcatcgaagacaatccagagatcgaagatgacattttccgaaagaaaagattgaccatcatggacctccatccaggagcaggaaagacaaaaagataccttccagccatagttagagaagccataaaacgtggcttgagaacattaatactggcccccactagagttgtggcagctgaaatggaggaagctcttagaggacttccaataagataccaaaccccagccatcagagcagagcacaccgggcgggagatcgtggacctaatgtgtcatgccacatttactatgaggctgctatcaccagtcagagtgccaaattacaacctgatcatcatggacgaagcccacttcacagatccagcaagtatagcagctagaggatacatttcaactcgagtagaaatgggtgaagcagctgggattttcatgacagccactcctccgggaagtagagacccatttcctcagagcaatgcaccaatcatggatgaggaaagagaaatccctgagcgctcgtggaattcaggacatgaatgggtcacggattttaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaggagcgggtgatcttggcaggacctatgccagtgacccactctagtgcagcacaaagaagagggagaataggaagaaatccaaaaaacgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggttgatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcttcagtgaatgtctccctaacagccattgctaaccaagccacagtgttaatgggtcttgggaaaggatggccattgtcaaagatggacatcggagttcccctccttgccattggatgctattcacaagtcaaccctataactctcacagcagctcttcttttattggtagcacattatgccattataggaccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaatactaccattgcagtgtcaatggctaacatctttagggggagctacttggccggagctggacttctcttttccatcatgaagaacacaacaaacacaagaagaggaactggcaacataggagagacacttggagaaaaatggaaaagtcgattaaacgcactgggaaaaagtgaatttcagatctacaagaaaagtggaatccaggaagtggatagaaccttggcaaaagaaggcatcaaaagaggagaaacggaccaccacgctgtgtcgcgaggctcagcaaaattgagatggttcgtcgagagaaatatggtcacaccagaagggaaggtggtggacctcggttgcggcagagggggctggtcatactattgtgggggactgaagaatgtaagagaagtcaaaggcttgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtatcatcagtgaacatgatttcaaggatgttgattaacagattcacaatgaaacacaagaaagccacctacgagccagatgttgacttaggaagcggaacccgcaacattggaattgaaagtgagataccaaatctagacataataggaaagagaatagagagaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagtaatgcagccttgggggccgtattcactgatgagaacaaatggaaatcggctcgtgaggctgttgaagatagtaggttttgggagctggttgacagggaaagaaatctccatcttgaaggaaagtgtgaaacatgtgtgtacaacatgatgggaaaaagagaaaagaaactaggggagttcggcaaggcaaaaggcagcagagccatatggtacatgtggcttggagcacgcttcttagagtttgaagccctaggattcttgaatgaagatcactggttctccagaaggaactccctgagtggagtggaaggagaagggttgcacaggctaggctacattttaagagacgtgagcaagaaggaagggggagcgatgtacgccgatgatacagcaggatgggacacaagaatcacactagaagacctaaaaaatgaagaaatggtaacaaaccacatgaaaggagaacacaagaaactagccgaggccatattcaaattaacgtaccaaaataaggtggtgcgtgtgcaaagaccaacaccaagaggcacagtaatggatattatatcgagaagagaccaaagaggcagcgggcaagtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggccattagtggagatgattgtgttgtaaaacctttagatgacagatttgcaagtgctttaacagctctaaatgacatgggaaaagttaggaaagatatacaacaatgggaaccttcaagaggatggaacgactggacacaagtgcctttctgctcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgaccttagactggcggcaaatgccatttgctcggcagtcccgtcacattgggttccaacaagtcgaacaacttggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtactgtggtag

SEQ ID NO: 822 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacagaagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgtccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaattgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagactattcttgaactgactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagatgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggagttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcatcgaaaattcctcagtgaatgtctccctaacagccattgctaaccaggccacagtgctaatgggtcttgggagaggatggccattgtcaaagatggacatcggagttcccctccttgccattggatgctattcacaagtcaaccctataactctcacagcagcccttcttttgctggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactaatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacattagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggttccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccatggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 823 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaaaggaggcattgtgacctgtgctaagtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttatcgatggccctgaaacagcagaatgccccaacacaaacagagcctggaactcgctggaagttgaagactatggttttggagttttcaccaccaatatatggctgaaattgagagataaacaggatgtattttgtgactcaaaactcatgtcagcggccattaaagacaacagagccgttcatgctgatatgggttattggatagaaagtgcactcaatgacacatggaagatggaaaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtatgggatggaaatcagaccattgaaagagaaagaagagaatttggtcaactccttggtcacagccggacatgggcagattgacaacttttcactaggagtcttgggaatggcactgctcctggaagaaatgctcaggacccgaataggaacgaaacatgcaatactactagttgcagtgtcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctgggctactcttaagaaaactgacctccaaggaattgatgatggccaccataggaatcgcactcctttcccaaagcaccataccagaaaccattcttgaactgactgatgcattagccctgggcatgatggtcctcaaaatagtgagaaatatggaaaaataccaattggcagtgactgtcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgcgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatatggacaaaagaaggggaaaggaaaaagttaaaacccagatggttggatgctaggatctattctgacccactagcactaaaagaattcaaggaatttgcagctggaagaaaatctttgaccctgaacctaatcacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccggacccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaggaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaagcaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcattggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacttatggccttaataccttcaccaatatggaagcccaattaattagacagatggagggagaaggaatcttcaaaagcattcagcacctgacagccatagaagaaatcgctgtacagaactggctagcaagagtggggcgtgaaaggctatcaagaatggcaatcagtggagatgattgtgttataaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttggggaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaaccaagtcagatcccttataggcaatgaggaatacacagactacatgccatccatgaagagatttagaagggaagaggaagaggcaggtgtcctgtggtag

SEQ ID NO: 824 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagtagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaaatactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 825 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagtagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaaatactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgttccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgctacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 826 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgcatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaatccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagactggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaaatactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagagagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcggcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcacaccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatagcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagacctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgcgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 827 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacgacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaaatactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacagaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgtgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 828 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcggaaggggcctggaaacatgttcagagaattgaaacctggatcttgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtgacaagattggagaatctgatgtggaaacaaataacaccagaattgaatcacattctatcagaaaacgaggtaaagttgaccattatgacaggagacatcaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgcagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaggccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggattttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctatagctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccggaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattgtaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaacgaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgtcgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 829 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggtcgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttctatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttgctgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggaccatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagaccattcttgaactgactgatgcgttagccttgggcatgatggtcctcaaaatagtgagaaatctggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttataaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagacggaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactatgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcggtgaatgtctccttaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaggggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaaacaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccatatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacgcaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 830 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttaagagggttcaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaattctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgactttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccattctaaggaagtactgtatagaagcaaagctgaccaatacaacaacagaatctcgttgtccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaagaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtaactgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgatcaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagactattcttgaactgactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacactaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggatgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgattttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcatcgaaaattcctcagtgaatgtctccctaacagccattgctaaccaggccacagtgctaatgggtcttgggagaggatggccattgtcaaagatggacatcggagttcccctccttgccattggatgctattcacaagtcaaccctataactctcacagcagcccttcttttgctggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactgcaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactaatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccatggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 831 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgtccaacacaaggggaacccagtctaaatgaagagcaggacaaaaggttcatctgcaaacactccatggtagacagaggatggggaaatggatgtggattatttggaaaaggaggcattgtgacctgtgctatgttcatatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaattgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgaccgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggagctaatgatggccaccataggaatcgcactcctttcccaaagcaccataccagagactattcttgaactgactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctacgtagtcatagccatccttacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcatcgaaaattcctcagtgaatgtctccctaacagccattgctaaccaggccacagtgctaatgggtcttgggagaggatggccattgtcaaagatggacatcggagttcccctccttgccattggatgctattcacaagtcaaccctataactctcacagcagcccttcttttgctggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactaatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcggacaagtcggcacctatggccttaatactttcaccaacatggaagcccaattaattagacagatggagggagaaggaatttttaaaagcattcagcacctgacagtcacagaagaaatcgctgtacagaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaagccaagatgaactgattggtagagctcgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccatggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 832 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagcaaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaagagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 833 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcaacaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggcaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatatagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggggctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggtagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaataaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 834 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaattacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggaaatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtggagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagacaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaagagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 835 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgattttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaagagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 836 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgttttctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgctgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcagtcctggcatacaccataggaacgacacatttccaaagggccttgattttcgtcttactgacagctgtcgctccttcaatgacaatgcgctgcatagggatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaaaggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaagaattttgccgggccagtgtcacaacacaactacagaccaggctaccatacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtaatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacccggaaaaaatccaagagccgttcaaacgaaacctggaattttcaaaaccaacactggaaccataggcgccgtatctctggacttttcccctggaacatcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactagagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacttttgactctgagtatgttaagactagagctaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaacacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggcctggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaatgaaacaagagcatgaaatatcatggcactatgatcaagaccacccatacaaaacgtgggcttaccatggcagctatgaaacaaaacaaactggatcagcatcgtctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctctggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaagcagcaataaatcaagtcagatcccttataggcaatgaggaatatacagactacatgccatccatgaagagattcagaagggaagaggaagaggcaggtgtcctgtggtag

SEQ ID NO: 837 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttctgagagggttcaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtctcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgtccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtagtgacacaggaaaacatggcaaggaaattaaaataacaccacagagttccatcacagaagcagaactgacaggctatggaactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaattgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggcaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagactattcttgaactgactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggagttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggacgaagcccacttcacggatccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcatcgaaaattcctcagtgaatgtctccctaacagccattgctaaccaggccacagtgctaatgggtcttgggagaggatggccattgtcaaagatggacatcggagttcccctccttgccattggatgctattcacaagtcaaccctataactctcacagcagcccttcttttgctggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttctacaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtagacacgagaacccaagaaccgaaggaaggcacaaagaaactaatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacattagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccatggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaaaaggcaggtgtcctgtggtag

SEQ ID NO: 838 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccgcatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaagaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagttcaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagcggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcactggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttctcactaggagtcttgggaatggctctgttcctggaagaaatgctcaggacccgagtaggaacgaaacatgtaatactgctagttgcagtatctttcgtgacattgattaccgggaacatgtcctttagagacctgggaagagtgatggttatggtgggcgctaccatgacagatgacataggtatgggagtgacttaccttgccctactagcagctttcaaagttagaccaacttttgcagctggactactcttgagaaaactgacctccaaggaactaatgatggccaccataggaatcgcacttctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagtggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgcttactggacgatcggccgatttggaactggagagagctgccgatgtaaaatgggaagaccaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagatgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccgcagtcacaggaggaatcttcctattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagcccttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaagaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactagggaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttaggaaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 839 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgttttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttagaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtataatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactggaagacttaaaaaatgaagaaatggtaacaaaccacatgaaaggagaacacaagaaactagccgaggccatattcaaattaacgtaccaaaacaaggtggtgcgtgtgcaaagaccaacaccaggaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 840 - DNA, 10176 bp, Dengue virus
atgaacaaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacaacagggatactgaaaagatggggaacgatcaaaaaatcaaaagctatcaatgttctgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggtagacatagtcttagaacatggaagttgtgtgacgacgatggcaaaaaataaaccaacattggattttgaactgataaaaacagaagccaaacagcctgccactctaaggaagtactgtatagaagcaaagctgaccaatacaaccacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagctgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaggacaacagagccgtccatgccgatatgggttattggatagaaagtgcactcaatgacacatggaagatggagaaagcctctttcattgaagttaaaagctgccactggccaaagtcacacactctctggagcaatggagtattggaaagtgagatgataattccaaaaaattttgctgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacagatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgagtatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgacttggaactggagagagctgccgatgtaaaatgggaagatcaggcagaaatatcaggaagcagcccaatcctgtcaataacaatatcagaagatggcagcatgtcgataaaaaatgaagaggaagaacaaacactgactatactcatcagaacgggattgttggtgatctcaggagtctttccagtatcgataccaatcacggcagcagcatggtatttgtgggaagtgaagaaacaacgggctggagtattgtgggacgtcccttcacccccaccagtgggaaaagccgaactggaagatggagcctatagaatcaagcaaagagggattcttggatattcccagattggagctggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagctcacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctcttagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtagccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatttttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgatctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgttgtccctatggtgacacagatggcaatgacagacacgactccatttggacaacaacgcgttttcaaagagaaagtggacacgagaacccaagaaccgaaggaaggcacaaagaaattgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgtttcttagagtttgaagccctaggattcttgaatgaagatcactggttctccagagggaactccctgagtggagtggaaggagaagggctgcacagactaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaattttcaaaagcattcagcacctgacagttacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtatttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattaattgggctaacaagcagggctacctgggctaagaacatccaaacagcaataaatcaagtcagatcccttataggcaatgaggaatacacagactacatgccatctatgaagagattcagaaaggaagaggaagaggccggtgtcctgtggtag

SEQ ID NO: 841 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaattaaaaaatcaaaagccattaatgttttgagagggttcaggaaagagatcggaaggatgctgaacatcttgaataggaggcgcaggtctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgtaccctcatggctatggatcttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactatcatgacaggagacatcaaaggaatcatgcaggcaggaaaacgatccttgcggcctcagcccactgagctgaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtctgcggccataaaagacaacagagccgtccatgccgacatgggttactggatagaaagtgcactcaatgacacatggaagatagagaaagcctctttcattgaggtaaaaaactgccactggccgaaatcacacaccctctggagtaatggagtgctagaaagtgagatgataatcccaaagaatctcgctggaccagtgtctcaacacaattatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggttacagccggacatgggcaggttgacaatttttcactgggagtcttgggaatggcattgttcctggaggaaatgcttaggacccgagtaggaacgaaacatgcaatactactagttgcagtttcttttgtgacgttgatcacagggaacatgtccttcaaagacctaggaagagtggtggttatggtaggcgccacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattaactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccctacccatgggaaaggctgaactggaagatggagcctacagaatcaagcaaaaagggattcttgggtattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacatcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagaaaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaattataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatctcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaagaaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattagtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaacaccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgtttcctggagtttgaagccctaggattcctaaatgaagatcactggttctctagagagaactccctgagtggagtggaaggagaagggctgcacaagctaggttacattctaagagacgtgagcaagaaagagggaggagctatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacccttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaagcatgaatggatgacaacggaagacatgttgacggtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 842 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggggttaacatgtgcaccctcatggccatagaccttggtgaattgtgtgaagatacaatcacgtacaagtgtcccctcctcaggcaaaatgaaccagaagacatagattgttggtgcaactccacgtccacatgggtaacttatggaacatgtaccaccacaggagaacacagaagggaaaaaagatcagtggcactcgttccacatgtgggcatgggactggagacacgaactgaaacatggatgtcatcagaaggggcctggaaacacgttcagagaattgaaacctggatcttgagacatccaggctttaccacaatggcagcaatcctggcatacaccataggaacgacacatttccaaagggtcctgatcttcattttactgacagccgtcgctccttcaatgacaatgcgttgcataggaatatcaaatagagacttcgtagaaggggtttcaggaggaagttgggtcgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaagggggcattgtaacctgtgctatgttcacatgcaaaaagaacatggaaggaaaagttgtgctgccagaaaatctggaatacaccatcgtgataacacctcactcaggagaagagcacgctgtaggcaatgatacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaactggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgatcacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggccctccaccaagttttcggagcaatctatggggctgcttttagtggggtctcatggactatgaaaatcctcataggagttatcatcacatggataggaatgaattcacgtagcacctcactgtctgtgtcactagtattggtgggaatcgtgacactgtacttgggggttatggtgcaggctgacactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcactggaagttgaagactatggttttggagttttttctaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcgtggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagttggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagaaagctgccgatgtaaaatgggaagatcaggcagaaatatcaggaagtagcccaatcctgtcaataacaatatcagaagatggcagcatgtcgataaaaaatgaagaggaagaacatacactgaccatactaatcagaacgggattactggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagctaatgattgggattttgtggtcacaactgacatttcagaaatgggtgccaacttcagggctgagagggttatagaccccagacgttgcatgaaaccagttatactaacagatggcgaagagcgggtcatcttggcaggacctatgccagtgacccactccagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgctttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagtaacattctggacatagatctacgtcctgcatcagcatggacgctgtatgccgtggccacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctggtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaactttagcaaaagaaggcatcaaaagaggggaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaaccccacgatagaagcaggacgaacacttagagtcctcaacttagtggaaaattggttgaacaataacactcaattttgcgtaaaggttctcaacccatacatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagctacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagccttgggggccatattcactgatgagaacaaatggaaatcggctcgtgaggctgttgaagatagtaggttttgggaactggttgacagggaaagaaatcttcatcttgaaggaaagtgtgaaacatgtgtgtacaacatgatggggaaaagagagaagaaactaggggagttcggcaaggcaaaaggtagcagagccatatggtatatgtggcttggagcacgtttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtatcaaaacaaggtggtgcgtgtacaaagaccaacaccaagaggcacagtaatggacatcatatcgagaaaagaccaaagaggcagcgggcaagtcggcacctatggccttaatacttttaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcatgctcgtggttccatgcagaaaccaagatgaactgattggcagagcccgaatttctcagggagccgggtggtctttgaaggagacggcctgtttggggaagtcttacgcccaaatgtggaccttgatgtacttccacagacgtgacctcagactggcggcgaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 843 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattctactgacagccgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacactatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctacaggaaaggctctccaccaagttttcggagcaatctatggggcagcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgcggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgcgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccctggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggatatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaattgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctatcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaattaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgttcaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtggagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggactttaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctttggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactaccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagttttttctcatagttttgctcattccagaaccagaaaaacagagaacaccccaagacaaccaattgacctacgtagtcatagccatcctcacagtggtggctgcaaccatggcaaatgagatgggcttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggaagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatctccatcttgaggggaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaaggccaacaccaagaggcacagtaatggatatcatatcgagaaaagaccaaagaggcagcgggcaagtcggcacctatggcctcaatactttcaccaatatggaagcccaattaattagacagatggaaggagaaggaattttcaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagccagaatttcccagggagccgggtggtctttgaaggagacggcctgtttggggaagtcttacgcccaaatgtggaccttgatgtacttccacagacgtgacctcagactagcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 844 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgcgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctagaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcgtcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccctggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgatataggtatgggagtgacttaccttgccctactagcagccttcaaagttagaccaacttttgcagctggactactcttgaggaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgttcaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagatccagcaagtatagcagctagaggatatatttcaactcgagtggagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaactttagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggctacagtcacaggaggaatcttcttattcttaatgagcggaaaaggtatagggaagatgaccctgggaatgtgttgtataatcacggctagtatcctcctatggtacgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggcttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacgtgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaacacaagaaggggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacactcagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggttgcacaagctaggctacattttaagagatgtgagcaagaaggaagggggagcaatgtacgccgatgacacagcaggatgggacacgagaatcacactagaagacctaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaatatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtctggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgtggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 845 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcaatggcattccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgtccaacacaaggggagcccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaacagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccactgaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaacaaagaactgaaatgtggcagcgggatcttcattacagataacgtgcacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggattactcttgagaaaactgacctccaaggaactaatgatggccaccataggaatcgcactcctttcccaaagcaccataccagagactattcttgaactgactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttactgtgtgttacgtgctcactggacgatcggccgatttggaactggagagagctgccgatgtaaaatgggaagatcaggcagaaatatcaggaagcagtccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctatgtagtcatagccatcctcacagtggtggccgcaaccatggcaaatgagatgggtttcctggaaaaaaccaagaaagacctcggactgggaagcattataacccaggaatctgagagcaacatcctggacatagatttacgtcctgcatcagcatggacgctgtatgccgtggccacaacatttgttacaccaatgttgagacatagcatcgaaaattcctcagtgaatgtctccctaacagccattgctaaccaggccacagtgctaatgggtcttgggagaggatggccattgtcaaagatggacatcggagttcccctccttgccattggatgctattcacaagtcaaccctataactctcacagcagcccttcttttgctggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggaccttggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactaatgaggattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcggacaagtcggcacctatggccttaatactttcaccaacatggaagcccaattaattagacagatggagggagaaggaatttttaaaagcattcagcacctgacagtcacagaagaaatcgctgtacagaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaagccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccatggatggaagacaaaactctagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 846 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgtccagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgtctctcatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcgtcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccgttttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccctggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgaggaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtggagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttggataacatcaacacacctgaaggaatcattcctagcatgttcgaaccagagcgtgaaaaggtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaactcttatgactcagaaggcaagagacgcactggacaacttagctgtgctgcatacggctgaggtaggtggaagggcttacaatcatgctctcagtgaactgccggagaccctggagacactgcttttactgacactcctggctacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggcttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacgtgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacactcagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaatcgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagatgtgagcaagaaggaagggggagcaatgtacgccgatgacacagcaggatgggacacgagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaatatggaagcccaattaattagacagatggagggagaaggaatttttaaaagcattcagcgcctgacagtcacagaagaaatcgctgtgcagaactggttagtaagagtggggcgtgaaaggctatcaagaatggccgtcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtctggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 847 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggggttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatggaacatgtaccaccacaggagaacacagaagggaaaaaagatcagtggcactcgttccacatgtgggcatgggactggagacacgaactgaaacatggatgtcatcagaaggggcctggaaacacgttcagagaattgaaacctggatcttgagacatccaggctttaccacaatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggcaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggaatcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattactggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctggtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggggaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatacatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgtttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtacaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcatgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcgaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 848 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgttttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagccttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaatcacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 849 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctattaatgttttgagagggttcaggaaagagattggaaggatgctgaacatcttgaacaggagacgcaggacagcaggcgtgattgttatgttgattccaacagtgatggcgttccatttgaccacacgcaatggagaaccacacatgatcgttggtaggcaggagaaagggaaaagtcttctgttcaaaacagaggatggtattaacatgtgtaccctcatggccatagaccttggtgaattgtgtgaagatacaatcacgtacaagtgccctctcctcaaacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccatagggacgacacatttccaaagggccttgattttcatcttactgacagctgtcgctccttcaatgacaatgcgctgcataggaatatcaaacagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaaaggaggcattgtgacctgtgctatgtttacatgcaaaaagaacatggaaggaaaagtcgtacagccagaaaatttggaatacaccatcgtgataacacctcactcaggagaagaacacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcacttttaaaaatccccacgcgaagaaacaggatgtcgttgttttagggtctcaagaaggggccatgcacacggcactcacaggggccacagaaatccagatgtcgtcaggaaacttactgttcacaggacatctcaagtgcaggctgagaatggacaagctacagctcaaaggaatgtcatactctatgtgtacaggaaaatttaaaattgtgaaggaaatagcagaaacacaacatggaacaatagttatcagagtacaatatgaaggagacggttctccatgtaagatcccttttgagataacagatttggaaaaaagacacgtcttaggtcgcctgattacagtcaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggattttggatccctgggaggggtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcttggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgcattttgtgactcaaaactcatgtcagcggccattaaagacaacagagccgtccatgccgatatgggttattggatagaaagtgcactcaatgacacatggaagatggagaaagcctcattcattgaagttaaaagctgccactggccaaagtcacacaccctctggagcaatggagtattagaaagtgagatgataattccaaaaaattttgccgggccagtgtcacaacacaaccacagaccaggttaccatacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatctcttgtgacattgattactgggaacatgtcttttagagaccttggaagagtgatggttatggtgggcgctaccatgacggatgacataggcatgggagtgacttatcttgccctactagcagctttcaaagttagaccaacttttgcagctggactactcttgagaaaactgacctccaaggaattaatgatggccaccataggaattgcactcctttcccaaagcaccataccagagaccattcttgaactgactgatgcgttagccttgggcatgatggtcctcaaaatagtgagaaatatggaaaaataccaattggcagtgactatcatggctatttcgtgcgttccaaatgcagtgatattgcaaaacgcatggaaggtgagttgcacaatattggcagcggtgtccgtttctccactgctcctaacatcctcacagcagaaagcggattggataccactggcattgacgataaaaggtctcaatccaacagccatttttctaacaactctctcgagaaccagcaagaaaaggagctggccgctaaatgaagctatcatggcagtcgggatggtgagcattttagccagttctctcctaaagaatgatattcccatgacaggtccactagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtcttgtgggacgtcccttcacccccaccagtggaaaaagccgaactggaagatggagcctatagaatcaagcaaagagggtttcttggatattctcagattggagccggagtttacaaagaaggaacattccatacaatgtggcacgtcacacgtggtgctgttcttatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacactggaaccataggcgccgtatctttggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaaaacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggacatgaatgggtcacggactttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgattttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagccaaaatgctcctagataacatcaacacacccgaaggaatcattcctagtatgtttgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatttggacaaaagaaggggaaaggaaaaaattaaaacccagatggttggatgctaggatctattctgacccactggcactaaaagaattcaaggaatttgcagctggaagaaaatctttgactctgaacctaatcacagaaatgggtaggcttccaactttcatgactcagaaggcaagaaatgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacacagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttgttggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatttacaagaaaagtggaatccaggaagtggatagaaccctagcaaaagaaggcataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctggtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacattgcaaaggaaatatggaggagccttggtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgtgttttcaaagagaaagtggacacgagaacccaagaaccgaaggaaggcacaaagaaactgatgaaaattacggcagagtggctttggaaagaactaggaaagaaaaagacacctagggtgtgtaccagagaagaattcacaagaaaagtgagaagcaatgcagccttgggggccattttcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggtaagaaggaagggggagcaatgtacgccgatgatacagcaggatgggacacaagaatcacactagaagacttaaagaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtggacaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaaatcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataagtcaagtcagatctcttataggcaatgaggaatacacagactacatgccatccatgaagagattcagaagggaagaggaagaggcaggtgtcctgtggtag

SEQ ID NO: 850 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgtaggacagcaggcgtgattattatgttgattccaacagcgatggcgttccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcggaaggggcctggaaacatgttcagagaattgaaacctggatcttgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgctgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgttacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaattgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcattatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtgacaagattggagaatctgatgtggaaacaaataacaccagaattgaatcatattctatcagaaaatgaggtaaagttgaccattatgacaggagacatcaaaggaatcatgcaggcaggaaaacgatctttgaggccccagcccactgagctgaagtactcatggaagacatggggaaaggcgaaaatgctctctacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaagatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgtagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagctttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaattctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggggttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggattttgtggtcacaactgacatttcagaaatgggtgccaacttcaaggctgaaagggtcatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacacagcattgaaaattcctcagtgaatgtctccctaacagctatagctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccggaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagagaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacttagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacccaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttaatcatgaaagatggccgcgtgctcgtagtcccatgtagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcggtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 851 - DNA, 10176 bp, Dengue virus
atgaataaccaacggaaaaaggcgagaaatacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgttttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacgcaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcacctaggtaagctcgagatggacttcgatttctgcgaaggaaccacagtggtggtgactgaggactgtggaaatagaggaccctctttaagaacgaccactgcctctggaaaacttataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagccagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 852 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaagggcgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatctaaccacacgtaatggagaaccacacatgatcgttggtaggcaagagaaagggaaaagtcttctgttcaaaacagaggatggtgtcaacatgtgtaccctcatggccatggaccttggtgaattgtgtgaagatacaatcacgtacaagtgtcccctcctcaggcaaaatgaaccagaagacatagactgttggtgcaactctacgtccacatgggtaacttatggaacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttgctgacagctgtcgctccttcaatgacaatgcgttgtataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccaccctaaggaagtactgtatagaagcaaagctgaccaatacaacaacagaatctcgctgcccaacacaaggggaacccagtctaaatgaagagcaggacaaaaggttcctctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctgtaggaaaggctctccaccaagttttcggagcaatctatggggctgcttttagtggggtctcatggactatgaaaatcttcataggagtcatcatcacatggataggaatgaattcacgtagcacctcactgtctgtgtcactagtgttggtgggagtcgtgacactgtacctgggagctatggtgcaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagattatggttttggagtttttaccaccaatatatggctaaaattgagagaaaaacaggatgtattttgtgactcaaaactcatgtcagccgccataaaagacaacagagccgtccatgccgatatgggttattggatagaaagtgcactcaatgacacatggaagatggagaaagcctctttcattgaagttaaaagctgtcactggccaaagtcacacaccctctggagtaatggagtattagaaagtgagatgataattccaaaaaattttgccgggccagtgtcacaacacaactacagaccaggctaccatacacaaacagcaggaccttggcatctaggtaagctagagatggactttgatttctgcgaaggaactacagtggtggtgactgaggactgtggaaatagaggaccctctttaagaacgaccactgcctctggaaaactcataacagaatggtgctgcagatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttccccactgctcttaacatcctcacagcagaaagcagattggataccactggcattgacgataaaaggcctcaatccaacagccatttttctaacaaccctttcgagaaccagcaagaaaaggagctggccgctaaatgaagctatcatggcagtcgggatggtaagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccggtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaggaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaaaacaaaaagataccttccagccatagttagagaagccataaaacgtggcttgagaacattaatcctggctcccactagagtcgtggcagctgaaatggaggaagctcttagaggacttccaataagataccaaaccccagctatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatctcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttagaaaaaatggaaagaaagtgatacaactcagtagaaagacttttgactctgagtatgttaagactagagccaatgattgggactttgtggtcacaactgacatttcagaaatgggtgccaacttcaaggctgagagggttatagaccccagacgctgtatgaaaccagttatactaacagatggcgaagagcgggtgatcttggcaggacctatgccagtgacccactctagtgcagcgcaaagaagagggagaataggaagaaatccaaaaaatgaaaatgaccagtatatatacatgggggaacctctggaaaatgatgaagactgtgcacattggaaagaagctaaaatgctcctagacaacatcaacacacctgaaggaatcattcctagtatgttcgaaccagagcgtgaaaaagtggatgccattgatggtgaataccgtttaagaggagaagcaaggaaaacctttgtggatctaatgagaagaggggacttaccagtctggttggcctacagagtggcagctgaaggcatcaactacgcagacagaaggtggtgttttgatggaatcaagaacaaccaaatactggaagaaaacgtggaagtggaaatctggacaaaagaaggggaaaggaagaaattaaaacccagatggttggatgctagaatctattctgacccactggcactaaaagaattcaaggaatttgcagctggaagaaaatctttgaccctgaacctaattacagaaatgggtaggcttccaactttcatgactcagaaggcaagagacgcactggacaacttagctgtgctgcatacggctgaggcaggtggaaaggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaagaatctgagagcaacatcctagacatagatctacgtcctgcatcagcatggacgctgtatgccgtggctacaacatttgtcacaccaatgctgagacatagcattgaaaattcctcagtgaatgtctccctaacagccattgctaaccaagccacagtgctaatgggtcttgggaaaggatggccattgtcaaagatggacatcggagttcccctccttgccattggatgctactcacaagtcaaccctataactctcacagcagctcttcttttgttggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgagaagcagttaggacaagtaatgctcctaatcctctgcgtgactcaagtactaatgatgaggactacatgggctctgtgtgaggctctaaccttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgatcaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacgtcatggcactatgaccaagaccacccatacaaaacgtgggcttaccatggcagttatgaaacaaaacaaactggatcagcatcatctatggtgaacggagtggtcaggctgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctagaatgtgtactagagaagaattcacaagaaaggtgagaagcaatgcagccttgggagccatattcactgatgagaacaaatggaagtcggcacgtgaggctgttgaagatagtaggttctgggagctggttgacagggaaagaaatctccatcttgaaggaaagtgtgaaacatgtgtgtacaacatgatgggcaaaagagagaagaaactaggggagttcggcaaggcaaaaggtagcagagccatatggtacatgtggcttggagcacgcttcttagagtttgaagccctaggattcttgaatgaagaccactggttctccagagggaactctctgagtggagtggaaggagaagggctgcataggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaacactttcaccaacatggaagcccaattaattagacagatggaaggagaaggaatcttcaagagcattcagcacttgacagttacagaagaaatcgctgtacagaactggttagcaagagtgggacgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 853 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaagggcgcggaccattgaaactgttcatggcccttgtggcgttccttcgtttcctgacaatcccaccaacagcagggatactaaaaagatggggaacgatcaaaaaatcaaaagctatcaatgttttgaaagggttcaggaaagagattggaaggatgctgaacatcttgaacaggagacgcaggacagcaggcgtgatcattatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaactgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggagggagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagaatacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccatcttaggtgacacagcctgggactttggatccctgggaggagtgttcacatctataggaaaggctctccaccaagttttcggagcaatctacggggctgcttttagtggggtctcatggaccatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcacgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcaaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgtgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccctggtcacagccggacatgggcagattgacaacttttcactaggagtcttgggaatggcactgttcctggaagaaatgctcaggacccgagtaggaacgaaacatgcaatactgctagttgcagtatcttttgtaacattgatcactgggaacatgtcttttagagacctgggaagagtgatggttatggtgggcgccaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttggccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagttagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccggaaaaaaagattgaccatcatggacctccatccaggagcaggaaagacaaaaagataccttccagccatagtcagagaagccataaagcgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcatgtctcaggaaaaatggaaagaaagtgatacaactcagtaggaaaacttttgactctgagtatgttaagaccagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcctatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatcttggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagttgatgagaatcacggcagagtggctttggaaagaactaggaaagaaaaagacccctagaatgtgcaccagagaagaattcacaagaaaagtgagaagcaatgcagccttgggggccatattcactgatgagaacaaatggaaatcggcacgcgaggctgttgaagatggtaggttttgggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgatatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagatgaactgattggtagagcccgaatttcccagggagccgggtggtctttgaaagagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactcctgtggaatcatgggaagaagtcccatacttgggaaaaagagaagaccaatggtgcggctcattaattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 854 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatggaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcttcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattaaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtactggtgggcgttgtgacactgtacctgggagctatggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacatcagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggctattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagctgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggatttttatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaatccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccctgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagtaatgtacgccgatgatacagcaggatgggacacaagaatcacactagaagacttaaaaaatgaagaattggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggcctcaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgtagtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgtggctcattgattgggctaacaagcagggctacctgggcaaagaacatccaaacagcaataaatcaagttagatcccttataggcaatgaggaatacacagactacatgccatccatgaagagatttagaagggaagaggaagaggcaggtgtcctgtggtag

SEQ ID NO: 855 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaagagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 856 - DNA, 10176 bp, Dengue virus; identical to SEQ ID NO: 768

SEQ ID NO: 857 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaatagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtagtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatctcttgtgacattgattactgggaacatgtcttttagagacctgggaagagtgatggttatggtgggcgctaccatgacggatgacataggtatgggagtgacttatcttgccctactagcagcttttaaggttagaccaacttttgcagccggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatacggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggattttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgtgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggaattgacgttttcttcaccccgccagaaaagtgtgatacattgttgtgtgacataggggagtcgtcaccaaaccccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgaccccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaagtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcaatgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 858 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacacggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacatagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcgaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggaatacaccatcgtgataacaccccactcaggagaagagcacgctgtaggtaatgacacaggaaagcatggcaaagaaatcaaaataacaccacagagttccatcacagaagctgaactgacaggctatggcactgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgatcacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgtagtgagttggaaaaataaagaactgaaatgtggcagcgggatcttcattacagataacgtacacacatggacagaacaatataagtttcaaccagaatccccttcaaaactagcttcagctatccaaaaagctcatgaagagggcatttgtggaatccgctcagtaacaagattggagaatctgatgtggaaacaaataacaccagaattgaatcatattctagcagaaaatgaggtaaagttgaccattatgacaggagacattaaaggaatcatgcaggcaggaaaacgatctttgcggccccagcccactgaactgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttcaccaccaatatatggctgaaattgagagaaaaacaggatgtattttgtgattcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtaactgaggactgtggaaatagaggaccctctttgagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgaataggaacgaaacatgcaatactgttagttgcagtatcttttgtgacattgataactgggaacatgtcttttagagacctgggaagagtgatggttatggtgggcgctaccatgacggatgacataggtatgggagtgacttatcttgccctactagcagcttttaaagttagaccgacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccaacaagaaaaggagctggccgctaaatgaagctatcatggcagtcgggatggtgagcattttagccagttctctcctaaagaatgatattcccatgacaggtccgttagtggctggagggctccttaccgtatgttacgtgctcactggacgatcggctgatttggaactggagagagctgctgatgtaaaatgggaagatcaggcagaaatatcgggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagccggagtctacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacatcttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcccccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacctttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaacgaaaatgaccagtacatatacatgggggaacctcttgaaaatgatgaagactgtgcacattggaaagaagctaaaatgctcctagataacatcaatacacccgaaggaatcattcctagtatgttcgaaccagagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgacccagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgccaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccaggaaggttttggaacactaccattgcagtgtcaatggccaacatctttagggggagctacttggccggagctggacttctcttttccattatgaaaaacacaacaagcacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgatgttttcttcaccccgccagaaaagtgtgatacattgttgtgtgacataggggagtcgtcaccaaatcccacgatagaagcaggacgaacactcagagtcctcaacttagtggaaaattggttgaacaataacaccaaattttgcataaaggtcctcaacccatatatgccttcagtcatagaaaaaatggaagcattacaaaggaaatatggaggagctttagtgaggaatccactctcacgaaactccacgcatgaaatgtactgggtatctaatgccaccgggaacatagtgtcatcagtgaacatgatttcaaggatgttgatcaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaatcttcaaaagcattcagcacctgacagccacagaagaaattgttgtacagaactggttagcaagagtggggcgtgaaaggctatcaagaatggcaatcagtggagatgattgtgttgtaaaacctatagatgacagatttgcaagtgctctaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 859 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtcccaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacactggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 860 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagaaccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacttttcttattgatggccctgaaacagcagaatgccccaacataaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacataccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaagatgggaagatcaggcagaaatatcaggaagcagtccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagatatcttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagagttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggagccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacacagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgacacagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttctatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcgtaaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacccaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtgggccgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 861 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttctgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagaaccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacttttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagtccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagatatcttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttccccagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggagccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacacagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctacatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttctatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccagaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacccaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgccttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 862 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgcaccctcatggccatagaccttggtgaattgtgtgaagatacaatcacgtacaagtgtcctctcctcagacaaaatgaaccagaagacatagattgttggtgcaactctacgtccacatgggtaacttatgggacatgcaccaccacaggagaacatagaagagaaaaaagatcagtggcgctcgttccacatgtgggtatgggactggagacacgaactgagacatggatgtcatcagaaggggcctggaaacatgttcagagaatcgaaacctggatcttgagacatccaggctttaccataatggcagcaatcctggcatacaccataggaacgacacatttccaaagggccttgattttcatcttactaacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcgaagctgaccaacacaacaacagaatcacgctgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggaatacaccatcgtgataacaccccactcaggagaagagcacgctgtaggtaatgacacaggaaagcatggcaaagaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcatacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgatcacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgtagtgagttggaaaaataaagaactgaaatgcggcagcgggatcttcatcacagataacgtacacacatggacagaacaatataagtttcaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgaactgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttcaccaccaatatatggctgaaattgagagaaaaacaggatgtattttgtgattcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtaactgaggactgtggaaatagaggaccctctttgagaacgaccactgcctctggaaaactcataacagaatggtgctgccgatcctgcacactaccacctctaagatacagaggtgaggatggatgctggtacgggatggaaattagaccattgaaagagaaagaggagaatttggtcaattccttggtcacagccggacatgggcagattgacaacttttcactaggagtcttgggaatggcactgttcctggaagaaatgctcaggacccgaataggaacgaaacatgcaacactactagttgcagtatcttttgtgacattgataactgggaacatgtcttttagagacctgggaagagtgatggttatggtgggcgctaccatgacggatgacataggtatgggagtgacttatcttgccctactagcagcttttaaagttagaccgacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagctgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaagtgggaagatcaggcagaaatatcaggaagcagcccaatcctgtcaataacaatatcagaagatggcagcatgtcgataaaaaatgaagaggaagaacaaacgctgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagccggagtctacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacatcttccgaaagaaaagattgaccatcatggacctccatccaggagcaggaaagacaaaaagataccttccagccatagttagagaagccataaaacgtggcctgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagctgggatttttatgacagccactcccccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacctttgactctgagtatgttaagactagagccaatgattgggactttgtggtcacaactgacatttcagagatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaacgaaaatgaccagtacatatacatgggggaaccccttgaaaatgatgaagactgtgcacattggaaagaagctaaaatgctcctagataacatcaatacacccgaaggaatcattcctagtatgttcgaaccagagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatttattctgacccactggcactaaaagaattcaaggaatttgcagctggaagaaaatctttgaccctgaacctaatcacagaaatgggtaggcttccaactttcatgacccagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgccaaccaagctacagtgctaatgggtcttgggaaaggatggccattgtcaaagatggacattggagttcccctccttgccattggatgctattcacaagtcaaccccataactctcacagcagcccttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccattatgaaaaacacaacaagcacaagaagaggaactggcaacataggagagacacttggagaaaaatggaaaagtcgattaaacgcactaggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgatgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtattgggtatctaatgccaccgggaacatagtgtcatcagtgaacatgatttcaaggatgttgatcaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagttggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaatcttcaaaagcattcagcacctgacagccgcagaagaaaatgttgtacagaactggttggcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 863 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcagggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgaggacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtctgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctgtcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 864 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgtttaaaacagaggatggtgttaacatgtgcaccctcatggccatagaccttggtgaattgtgtgaagatacaatcacgtacaagtgccccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggctctgatcttcattttactgacagccgttgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaagggaggcattgtgacctgtgctatgttcacatgcaaaaagaacatggaaggaaaagtcgtgcagccagaaaatctggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacgttggtcactttcaaaaatccccacgcgaagaaacaggacgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagtgaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttattatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttttccacaaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcatctaggtaagcttgagatggactttgatctctgtgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatttcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagttgggatggtgagcattttagccagttctctcctaaagaatgacattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggtttgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgccatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggactttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacacttctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataaccctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacggtagaagcaggacgaacacttagagtcctcaacttagtggaaaattggttgaacaataacacccaattttgcgtaaaggttctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaggaagaagacacccaggatgtgtaccagagaagaatttacaagaaaggtgagaagcaatgcagccttgggggccatattcactgatgagaacaaatggaaatcggcacgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaattacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaacaccttcaccaacatggaagcccaattaattagacagatggagggagaaggaatttttaaaagcattcagcgcctgacagtcacagaagaaatcgctgtgcagaactggttagcaagagtggggcgtgaaaggttatcaagaatggccatcagtggagatgactgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 865 - DNA, 10176 bp, Dengue virus
atgaataaccaacggaaaaaggcgagaagtacgcctttcaatatgctgaaacgcgagagaaaccgcgtgtcaactgtgcaacagctgactaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagtaatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgccccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggctctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacactatcgtgataacacctcactcaggagaagagcacgctgtaggtaatgacacaggaaaacatggcaaggaaattaaaataacaccacagagctccatcacagaagcagaactgacaggctatggcactgtcacgatggagtgctctccgagaacgggcctcgacttcaatgagatggtgctgctgcagatggaagacaaagcctggctggtgcacaggcaatggttcctagatctgccgttaccatggctacccggagcggacacacaaggatcaaattggatacagaaagagacgttggtcactttcaaaaatccccacgcgaagaaacaggacgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagtgaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttttccacaaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcgcacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgtgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctactatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcagattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggtttgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcttatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgccatagcccagaccgaaaaaagcattgaagacaatccagagatcgaagatgacattttccgaaagaaaagattgaccatcatggatctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagctcacttcacggacccagcaagtatagctgctagaggatatatctcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatcgggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgctgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaagcacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagagatcgctgtgcagaactggttagcaagagtggggcgtgaaaggttatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 866 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaagggcgcggaccattgaaactgttcatggcccttgtggcgttccttcgtttcctgacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgatcattatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaactgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggagggagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactggtcacaggacatctcaagtgcagactgagaatggacaaactacagctcaaaggaatgtcatactctatgtgtacaggaaagtttaaaattgtgaaagaaatagcagaaacacaacatggaacaatagttatcagaatacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccatcttaggtgacacagcctgggactttggatccctgggaggagtgttcacatctataggaaaggctctccaccaagttttcggagcaatctacggggctgcttttagtggggtctcatggaccatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcacgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcaaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgtgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccctggtcacagccggacatgggcagattgacaacttttcactaggagtcttgggaatggcactgttcctggaagaaatgctcaggacccgagtaggaacgaaacatgcaatactgctagttgcagtatcttttgtaacattgatcactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttggccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccacacaatgtggcacgtcacacgtggtgctgttctgatgcatagagggaagaggattgaaccatcatgggcagatgtcaagaaagacctaatatcatatggaggaggctggaagttagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagccaatccagagatcgaagatgccattttccgaaaaaaaagattgaccatcatggacctccatccaggagcaggaaagccaaaaagatcccttccagccatagtcagagaagccataaagcgtggcttgagaccattaattctggctccccctagagtcgtgccagctgaaatggaggaacctcttagaggcctcccaataagataccaaaccccagccatcaaacccgaccataccggccgggagatcgtggccctaatgtgccatgccccatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcatgtctcaggaaaaatggaaagaaagtgatacaactcagtaggaaaacttttgactctgagtatgttaagaccagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcttatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatcttggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaggttgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgcgaggctgttgaagatggtaggttttgggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgatatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagatgaactgattggtagagcccgaatttcccagggagccgggtggtctttgaaagagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactcctgtggaatcatgggaagaagtcccatacttgggaaaaagagaagaccaatggtgcggctcattaattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 867 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaagggcgcggaccattgaaactgttcatggcccttgtggcgttccttcgtttcctgacaatcccaccaacagcagggatactaaaaagatggggaacgatcaaaaaatcaaaagctatcaatgttttgaaagggttcaggaaagagattggaaggatgctgaacatcttgaacaggagacgcaggacagcaggcgtgatcattatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaactgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggagggagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagaatacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccatcttaggtgacacagcctgggactttggatccctgggaggagtgttcacatctataggaaaggctctccaccaagttttcggagcaatctacggggctgcttttagtggggtctcatggaccatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcacgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcaaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgtgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccctggtcacagccggacatgggcagattgacaacttttcactaggagtcttgggaatggcactgttcctggaagaaatgctcaggacccgagtaggaacgaaacatgcaatactgctagttgcagtatcttttgtaacattgatcactgggaacatgtcttttagagacctgggaagagtgatggttatggtgggcgccaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttggccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagttagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccggaaaaaaagattgaccatcatggacctccatccaggagcaggaaagacaaaaagataccttccagccatagtcagagaagccataaagcgtggcttgagaacattaattctggctcccactagagtcgtggcagctgaaatggaggaagctcttagaggactcccaataagataccaaaccccagccatcaaagccgagcataccgggcgggagatcgtggacctaatgtgccatcccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcatgtctcaggaaaaatggaaagaaagtgatacaactcagtaggaaaacttttgactctgagtatgttaagaccagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcctatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatcttggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagttgatgagaatcacggcagagtggctttggaaagaactaggaaagaaaaagacccctagaatgtgcaccagagaagaattcacaagaaaagtgagaagcaatgcagccttgggggccatattcactgatgagaacaaatggaaatcggcacgcgaggctgttgaagatggtaggttttgggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgatatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagatgaactgattggtagagcccgaatttcccagggagccgggtggtctttgaaagagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactcctgtggaatcatgggaagaagtcccatacttgggaaaaagagaagaccaatggtgcggctcattaattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 868 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctgacaatcccaccaacagcagggatactaaaaagatggggaacgatcaaaaaatcaaaagctatcaatgttttgagagggttcaggaaagagattggaaggatgctgaacatcttgaacaggagacgtaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacctacaagtgtcctctcctcagacaaaatgaaccagaagacatagactgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaagcatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggagtatcaaatagagacttcgtagaaggggtttcaggaggaagctgggttgatatagtcttggaacatggaagttgtgtgacgacgatggcaaaaaacaaaccaacattggattttgaactgataaaaacagaagccaaacaacctgccactctaaggaaatactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtagtgcagccagaaaatttggaatacaccatcgtgataacacctcactcaggagaagagcacgctgtaggtaatgacacaggaaaacatggcaaggaaatcaaaataacaccacagagttccatcatagaagcagaactgacaggctatggcactgtcacgatggagtgctctccgagaacgggccttgacttcaatgagatggtgctgctgcagatggaagacaaagcttggctggtgcacaggcaatggttcctagacctgccgttaccgtggctacctggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttgggccgcctgatcacagttaacccaatcgtaacaggaaaagatagcccagtcaacatagaagcagaacctccattcggggacagctacatcatcataggagtagagccgggacaattgaaactcaattggtttaagaagggaagttccatcggccaaatgttcgagacaacaatgagaggagcaaagagaatggctattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtactggtgggagtcgtgacactgtacctgggagctatggtgcaggctgatagtggctgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgcggaatccgctcagtaacaagattggagaacctgatgtggaaacaaataacaccagaattgaatcatattctatcagaaaatgaagtaaagttgaccattatgacaggagacattaaaggaatcatgcaagcaggaaaacgatccttgcggccccagcccactgagctgaagtactcatggaaaacatggggaaaggcgaaaatgctctccacagaatctcacaaccagacctttcttattgatggccctgaaacagcagaatgccccaatacaaacagagcttggaactcactggaagttgaagactatggttttggagtttttaccaccaatatatggctaaaattgagagaaaaacaggatgtattttgtgactcaaaactcatgtcagcggccatcaaagacaacagagccgttcacgccgatatgggttattggatagaaagcgcactcaatgacacatggaagatggagaaagcctccttcattgaagttaaaagctgccattggccaaagtcacacaccctttggagcaatggagtattagagagtgagatgataattccaaaaaactttgccgggccagtgtcacaacacaactacagaccaggctaccatacacaaacagcaggaccttggcatctaggtaagcttgagatggactttgatttctgcgaaggaactacagtagtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgcaaccatgacggatgacataggtatgggagtgacttatcttgccctactagcagctttcaaagttagaccaacttttgcagctggactactcttgagaaaactgacctccaaagaattaatgatggccaccataggaatcgcactcctttcccaaagcaccataccagagaccattcttgaactgactgatgcgttagccttgggcatgatggtcctcaaaatagtgagaaatatggaaaaataccaattggcagtgactgtcatggctatttcgtgtgtcccaaatgcagtgatactgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttactgtatgttacgtgctcactggacgatcggctgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcgtggtacctgtgggaagtgaagaaacaacgggctggagtattgtgggacgttccttcacccccaccagtgggaaaagccgaactggaggatggagcctacagaattaagcaaagagggattcttggatattctcagattggagccggagtttacaaagaaggaacattccatacaatgtggcacgtcacacgtggtgctgtcctgatgcatagagggaagaggattgaaccatcatgggcagatgtcaagaaagacttaatatcatatggaggaggctggaagctagaaggagaatggaaggaaggagaggaagtccaagtcctggcactggaacctggaaaaaatccaagagccgtccaaacaaaacctggaattttcaaaaccgacaccggaaccataggcgccgtatctctggacttttcccctggaacgtcaggatctccaattgtcgacagaaagggaaaggttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagccgaaatggaggaagctcttagaggacttccaataagataccaaaccccagccatcaaagccgaacacaccgggcgggagattgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagacagtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaatttcaaggctgagagggttatagaccccagacgttgcatgaaaccagtcatactaacagatggcgaagagcgggtgatcttggcaggacctatgccagtgacccactctagtgcagcacaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttggccctgaacctaatcacagaaatgggtaggcttccaactttcatgacccagaaggcaagaaacgcactggacaacttggctgtgctgcatacggctgaggcaggtggaagggcgtacaatcatgctctcagtgaactgccggagactctggagacactgcttctactgacactcctggcaacagtcacaggaggaatcttcttattcttaatgagcggaaaaggtatagggaagatgaccctgggaatgtgttgcataatcacggctagtgtcctcctatggtatgcacagatacaaccacactggatagcagcttcaataatactggagttttttctcatagttttgctcattccagagccagaaaaacagagaacaccccaagacaaccaattgacctacgttgtcatagccatcctcacagtggtggctgcaaccatggcaaacgagatgggtttcctggaaaaaaccaagaaagacctcggattgggaagcattacaacccaggaatctgagagcaacatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattataggcccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccctagcgaccgggcccatctccacactgtgggaaggaaatccagggaggttttggaacactaccatcgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcgctggggaaaagtgaatttcagatctacaagaaaagtggaatccaggaagtggatagaaccctagcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatacatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactactgacaaaaccttgggacgtcgtccctatggtgacacagatggcaatgacagacacgactccatttggacaacagcgcgttttcaaggagaaagtagacacgagaacccaagaaccgaaggaaggcacgaagaagctgatgaaaatcacggcagagtggctttggaaagaactaggaaagaaaaagacacctaggatgtgtaccagagaagaattcacaagaaaagtgagaagcaatgcagccttgggggccatattcaccgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaagcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggatacaagaatcacactagaagatttaaaaaatgaagaaatggtaacaaaccacatgaaaggagaacacaagaaactagctgaggccatattcaaattaacgtaccaaaataaggtggtgcgtgtgcaaagaccaacaccaagaggcacagtaatggatatcatatcgagaaaagaccaaagaggcagtggacaagtcggcacctatggccttaatactttcaccaatatggaagcccaattaatcagacagatggaaggagaaggaatctttaaaagcattcagcacctgacagccacagaagaaatcgctgtacagaactggttaacaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttgggaaaaagagaagaccaatggtgtggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgttctgtggtag

SEQ ID NO: 869 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaagggcgcggaccattgaaactgttcatggcccttgtggcgttccttcgtttcctgacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgatcattatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaactgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggagggagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagaatacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccatcttaggtgacacagcctgggactttggatccctgggaggagtgttcacatctataggaaaggctctccaccaagttttcggagcaatctacggggctgcttttagtggggtctcatggaccatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcacgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcaaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgtgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccctggtcacagccggacatgggcagattgacaacttttcactaggagtcttgggaatggcactgttcctggaagaaatgctcaggacccgagtaggaacgaaacatgcaatactgctagttgcagtatcttttgtaacattgatcactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttggccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccacacaatgtggcacgtcacacgtggtgctgttctgatgcatagagggaagaggattgaaccatcatgggcagatgtcaagaaagacctaatatcatatggaggaggctggaagttagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaaaaaaagattgaccatcatggacctccatccaggagcaggaaagacaaaaagataccttccagccatagtcagagaagccataaagcgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcatgtctcaggaaaaatggaaagaaagtgatacaactcagtaggaaaacttttgactctgagtatgttaagaccagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcttatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatcttggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaggttgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgcgaggctgttgaagatggtaggttttgggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaatcaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgatatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagatgaactgattggtagagcccgaatttcccagggagccgggtggtctttgaaagagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactcctgtggaatcatgggaagaagtcccatacttgggaaaaagagaagaccaatggtgcggctcattaattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 870 - DNA, 10176 bp, Dengue virus; identical to SEQ ID NO: 786

SEQ ID NO: 871 - DNA, 10176 bp, Dengue virus; identical to SEQ ID NO: 786

SEQ ID NO: 872 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggagaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatcttggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 873 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaagaatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgcttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacagcggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccattgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgagggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 874 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagtagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaaatactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagactcatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacattggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 875 - DNA, 10176 bp, Dengue virus
atgaataaccaacggaaaaaggcgagaaatacgcctttcaatatgctgaaacgcgagagaaaccgcgtgtcaactgtgcaacagctgacaaagagattctcacttggaatgctgcaaggacgaggaccattaaaactgttcatggcccttgtggcgtttcttcgtttcctaacaatcccaccaacagcagggatactgaaaagatggggaacgatcaaaaaatcaaaagctattaatgttttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgctggtgcaactctacgtccacatgggtaacttatgggacatgtaccaccacaggagaacacagaagagaaaaaagatcagtggcactcgttccacatgtaggcatgggactggagacacgaactgaaacatggatgtcatcagaaggggcctggaaacatgttcagagaattgaaacctggatcttgagacatccaggctttaccataatggcagcaatcctggcatacaccataggaacgacacattttcaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacgcaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacatcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttctccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgttaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagccagaggatatatttcaactcgagtagagatgggtgaagcagccgggattttcatgacagccactcctccgggaagtagagacccatttcctcagagcaatgcaccaattatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggatatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttctcagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 876 - DNA, 10176 bp, Dengue virus
atgaataaccaacggaaaaaggcgagaaatacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgttttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacgcaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgttaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagccagaggatacatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgcaaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttggttaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaagcaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttctcagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 877 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgttttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatttgtaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagtacgctgtaggtaatgacacaggaaaacatggcaaggaaattaaaataacaccacagagttccatcacagaagcagaactgacaggctatggcactgttacgatggagtgctctccgagaacgggcctcgacttcaatgaaatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgttgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacgtagaagcagaacctccattcggagacagctacatcatcataggagtagagccgggacaattgaaactcaattggttcaagaagggaagttctattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactatctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggggttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggaaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaactggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaagaagaacaaacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttatggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaagcgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagccgcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaaaggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggccagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaaaaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattctgcataaaggttctcaacccatatatgccctcagtcatagaaaaaatggaaacactacaaaggaaatatggaggagccttggtgaggaatccactctcacgaaactccacacatgagatgtactgggtatccaatgctactgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtcgtcagactgctgacaaaaccttgggacgtcgtccctatggtgacacagatggcaatgacagacacgactccatttggacaacaacgcgttttcaaagagaaagtagacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 878 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgttttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatttgtaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagtacgctgtaggtaatgacacaggaaaacatggcaaggaaattaaaataacaccacagagttccatcacagaagcagaactgacaggctatggcactgttacgatggagtgctctccgagaacgggcctcgacttcaatgaaatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgttgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacgtagaagcagaacctccattcggagacagctacatcatcataggagtagagccgggacaattgaaactcaattggttcaagaagggaagttctattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactatctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggggttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggaaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaactggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggcctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttatggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaagcgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagccgcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgattttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaaaggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggccagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatttccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaaaaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattctgcataaaggttctcaacccatatatgccctcagtcatagaaaaaatggaaacactacaaaggaaatatggaggagccttggtgaggaatccactctcacgaaactccacacatgagatgtactgggtatccaatgctactgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtcgtcagactgctgacaaaaccttgggacgtcgtccctatggtgacacagatggcaatgacagacacgactccatttggacaacaacgcgttttcaaagagaaagtagacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagagggtggaacgattggacacaagtgcctttctgttcacaccatttccatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 879 - DNA, 10176 bp, Dengue virus; identical to SEQ ID NO: 762

SEQ ID NO: 880 - DNA, 10176 bp, Dengue virus; identical to SEQ ID NO: 805

SEQ ID NO: 881 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaatatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacggactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaaatcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggccaccataggaatcgcactcctttcccaaagcaccataccagagaccattcttgaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggagaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcgagaaacgcactggacaacttggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacgacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgactaaacgcattggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcagagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagctacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagctgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 882 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaattgttcatggcccttgtggcgctccttcgtttcctaacaatcccaccaacagcagggatactaaaaagatggggaacgataaaaaaatcaaaagctatcaatgttttgagagggttcaggaaagagattggaaggatgctgaacatcttgaacaggagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacatagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacggaagccaaacaacctgccactctaaggaagtactgtatagaagcgaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttagaatacaccatcgtgataacaccccactcaggagaagagcacgctgtaggtaatgacacaggaaagcatggcaaagaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacagggcatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgatcacagttaacccaatcgtaacagaaaaagatagcccagtcaacatagaagcagaacctccattcggagacagctatatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcaagctgatagtggttgcgtagtgagttggaaaaataaagaactgaaatgtggcagcgggatcttcatcacagataacgtacacacatggacagaacaatataagtttcaaccagaatccccttcaaaactagcttcagctatccaaaaagctcatgcagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgaactgaagtactcatggaaaacatggggaaaggcgaaaatgctctccacagagtctcacaatcagacctttcttattgatggccctgagacagcagaatgccccaacacaaacagagcttggaattcgctggaagttgaagactatggttttggagttttcaccaccaatatatggctgaaattgagagaaaaacaggatgtattttgtgattcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtaactgaggactgtggaaatagaggaccctctttgagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgaataggaacgaaacatgcaatactgctagttgcagtatcttttgtgacattgataactgggaacatgtcttttagagacctgggaagagtgatggttatggtgggcgctaccatgacggatgacataggtatgggagtgacttatcttgccctactagcagcttttaaagttagaccgacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagagatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagccggagtctacaaagaaggaacattccatacaatgtggcacgtcacacgtggtgctgttctgatgcacagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtaagtgctatagcccagaccgaaaaaagcattgaagacaatccagagatcgaagatgacatcttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcccccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacctttgactctgagtatgttaagactagagccaatgattgggactttgtggtcacaactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaacgaaaatgaccagtacatatacatgggggaacctcttgaaaatgatgaagactgtgcacattggaaagaagctaaaatgctcctagataacatcaatacacccgaaggaatcattcctagtatgttcgaaccagagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgacccagaaagcaagaaacgcactggacaacttggctgtgctgcatacggctgaggcaggtggaagggcgtacaatcatgctctcagtgaactgccggagaccctggagacactgcttttactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggaattttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgccaaccaggctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggccaacatctttagggggagctacttggccggagctggacttctcttttccattatgaaaaacacaacaagcacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgatgttttcttcaccccgccagaaaagtgtgatacattgttgtgtgacataggggagtcgtcaccaaatcccacgatagaagcaggacgaacactcagagtcctcaacttagtggaaaattggttgaacaataacacccagttttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgatcaacagattcacaatgaaacacaagaaaaccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggcaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaatcttcaaaagcattcagcacctgacagccacagaagaaattgttgtacagaactggttggcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaagaatacacagactacatgccatccatgaagagattcagaagggaagaggaagaggcaggtgtcctgtggtag

SEQ ID NO: 883 - DNA, 10176 bp, Dengue virus; identical to SEQ ID NO: 806

SEQ ID NO: 884 - DNA, 10176 bp, Dengue virus; identical to SEQ ID NO: 805

SEQ ID NO: 885 - DNA, 10176 bp, Dengue virus; identical to SEQ ID NO: 805

SEQ ID NO: 886 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacacggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacatagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcgaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggaatacaccatcgtgataacaccccactcaggagaagagcacgctgtaggtaatgacacaggaaagcatggcaaagaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgatcacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacttgggagctatggtgcaagctgatagtggttgcgtagtgagttggaaaaataaagaactgaaatgtggcagcgggatcttcattacagataacgtacacacatggacagaacaatataagtttcaaccagaatccccttcaaaactagcttcagctatccaaaaagctcatgaagagggcatttgtggaatccgctcagtaacaagattggagaatctgatgtggaaacaaataacaccagaattgaatcatattctagcagaaaatgaggtaaagttgaccattatgacaggagacattaaaggaatcatgcaggcaggaaaacgatctttgcggccccagcccactgaactgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttcaccaccaatatatggctgaaattgagagaaaaacaggatgtattttgtgattcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtaactgaggactgtggaaatagaggaccctctttgagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgaataggaacgaaacatgcaatactattagttgcagtatcttttgtgacattgataactgggaacatgtcttttagagacctgggaagagtgatggttatggtgggcgctaccatgacggatgacataggtatgggagtgacttatcttgccctactagcagcttttaaagttagaccgacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccaacaagaaaaggagctggccgctaaatgaagctatcatggcagtcgggatggtgagcattttagccagttctctcctaaagaatgatattcccatgacaggtccgttagtggctggagggctccttaccgtatgttacgtgctcactggacgatcggctgatttggaactggagagagctgctgatgtaaaatgggaagatcaggcagaaatatcgggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagccggagtctacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacatcttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcccccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacctttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaacgaaaatgaccagtacatatacatgggggaacctcttgaaaatgatgaagactgtgcacattggaaagaagctaaaatgctcctagataacatcaatacacccgaaggaatcattcctagtatgttcgaaccagagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgacccagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgctgtggctacaacatttgtcacaccaatgttgagacatagcattgaaaattcctcagtgaatgtctccctaacagccattgccaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccaggaaggttttggaacactaccattgcagtgtcaatggccaacatctttagggggagctacttggccggagctggacttctcttttccattatgaaaaacacaacaagcacaagaagaggaactggcaacataggagagacacttggagaaaaatggaaaagtcgattaaacgcactgggaaaaagtgaatttcaaatctacaagaaaagtggaatccaggaagtggatagaaccctagcaaaagaaggtatcaaaagaggagaaacagaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgatgttttcttcaccccgccagaaaagtgtgatacattgttgtgtgacataggggagtcgtcaccaaatcccacgatagaagcaggacgaacactcagagtcctcaacttagtggaaaattggttgaacaataacaccaaattttgcataaaggtcctcaacccatatatgccttcagtcatagaaaaaatggaagcattacaaaggaaatatggaggagctttagtgaggaatccactctcacgaaactccacgcatgaaatgtactgggtatctaatgccaccgggaacatagtgtcatcagtgaacatgatttcaaggatgttgatcaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaatcttcaaaagcattcagcacctgacagccacagaagaaattgttgtacagaactggttagcaagagtggggcgtgaaaggctatcaagaatggcaatcagtggagatgattgtgttgtaaaacctatagatgacagatttgcaagtgctctaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 887 - DNA, 10176 bp, Dengue virus; identical to SEQ ID NO: 805

SEQ ID NO: 888 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattgaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaagtgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttaggttctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgctgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgataactgggaacatgtcttttagagacctgggaagagtgatggttatggtgggcgctaccatgacggatgacataggtatgggagtgacttatcttgccctactagcagcttttaaagttagaccgacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtattgtgggacgtcccttcacccccaccagtggaaaaagccgaactggaggatggagcctacagaatcaagcaaagagggatccttggatattctcagataggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaactacagccatcaaaaccgagcataccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaattacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaactaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgcgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccagttttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggttggcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 889 - DNA, 10176 bp, Dengue virus; identical to SEQ ID NO: 805

SEQ ID NO: 890 - DNA, 10176 bp, Dengue virus; identical to SEQ ID NO: 805

SEQ ID NO: 891 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtcccaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctggcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagtttggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 892 - DNA, 10176 bp, Dengue virus; identical to SEQ ID NO: 891

SEQ ID NO: 893 - DNA, 10176 bp, Dengue virus; identical to SEQ ID NO: 806

SEQ ID NO: 894 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctgacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcggaaggggcctggaaacatgttcagagaattgaaacctggatcttgagacatccaggctttaccataatggcagcaatcctggcatacaccataggaacaacacatttccaaagggccttgattttcatcttactgacggccgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgttgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcattatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtgacaagattggagaatctgatgtggaaacaaataacaccagaattgaatcacattctatcagaaaatgaggtaaagttgaccattatgacaggagacatcaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgtagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgagcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaggccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggattttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctatagctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccggaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 895 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctgacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattgttatgttgattccaacagcgatggcgttccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcggaaggggcctggaaacatgttcagagaattgaaacctggatcttgagacatccaggctttaccataatggcagcaatcctggcatacaccataggaacgacacatttccaaagggccttgattttcatcttactgacggccgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgttgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcattatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtgacaagattggagaatctgatgtggaaacaaataacaccagaattgaatcacattctatcagaaaatgaggtaaagttgaccattatgacaggagacatcaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgtagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgagcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaggccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccttttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtctcaggaaaaatggaaagaaagtgatacaactcagtaggaagacttttgattctgagtatgttaagactagagccaatgattgggattttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctatagctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccggaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagctcaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 896 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggagcgatcaaaaaatcaaaagctattaatgttttgagagggtttagaaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacagacaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaatgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttaccgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggccggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagctgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagctactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagattgtgcatattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccagagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacacagcattgaaaattcctcagtgaatgtctccctaacagccattgcaaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatattattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccaggaggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 897 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttctatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttgctgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggaccatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagaccattcttgaactgactgatgcgttagccttgggcatgatggtcctcaaaatagtgagaaatctggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagacggaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactatgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcatacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagacctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccatatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 898 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatattgaaaagatggggaacgatcaaaaaatcaaaagctattaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggcttcaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcctagaacatggaagttgtgtgacgacgatggcaaagaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattattcggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcaaagaaacaggatgtcgttgttttaggatctcaagaaggggccatgcacacggcactcacaggagccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaacgacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcagccaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagccgccataaaagacaacagagccgtccatgccgacatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgtgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttaggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgatataggtatgggagtgacttatcttgccctactagcagctttcaaagttagaccaacttttgcagctggactactcttgagaaaactgacctccaaggaattgatgatggccaccataggaatcgcactcctttcccaaagcaccataccagagaccattctagaactgactgatgcgttagccttgggcatgatggtcctcaagatagtgagaaatatggaaaagtaccaattggcagtgactatcatggctatctcgtgtgtcccaaatgcagtgatattgcaaaacgcatggaaggtgagttgcacaatattggcagtggtgtccgtttctccactgcttttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaagaagaacaaacactgactatactcattagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtctacaaagaaggaacattccatacaatgtggcacgtcacacgtggtgctgtcctgatgcatagagggaagaggattgaaccatcatgggcagacgtcaagaaggacctaatatcatatggaggaggctggaaactagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgactatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagagagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtttggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataattacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaaaaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacctggccggagctggacttctcttttccatcatgaagaacacaacaaacacaagaagaggaactggtaacataggagagacacttggagaaaaatggaaaagccgattaaacgcactggggaaaagtgaatttcagatctacaagaaaagtggaatccaggaagtggatagaaccttagcaaaagaaggcataaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaactaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaacactttcaccaacatggaagcccaattaattagacagatggagggggaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcgaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttgggaaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 899 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcggaaggggcctggaaacatgttcagagaattgaaacctggatcttgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcattatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtgacaagattggagaatctgatgtggaaacaaataacaccagaattgaatcacattctatcagaaaatgaggtaaagttgaccattatgacaggagacatcaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgtagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtggaaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgctgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggattttgtggtcacaactgacatttcagaaatgggtgccaacttcaaggctgaaagggttatagaccccagacgttgcatgaaaccagtcatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctatagctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccggaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaattagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaacactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 900 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcattccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccccagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaattgccggagaccctggagacactgcttttactgacactcctggccgcagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataaccctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagacgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcgcattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 901 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgatttttatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacaggaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctactatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactatgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 902 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaggggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactttaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacaccccactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctaattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaactcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcggacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggtaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaactttcgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcagggagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaaccaaggaatctgagagcaacatcctggacatagatctacgtcctgcatcagcatggacgttgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcaaatcccttataggcaatgaggaatacacagactacatgccatccatgaagagattcagaagggaagaggaagaggccggtgtcctgtggtag

SEQ ID NO: 903 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaggggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttacgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctaattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcggacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggtaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggtcatggtgggcgctaccatgacggatgacataggtatgggagtgacttatcttgccctactagcagctttcaaagttagaccaactttcgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgttgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 904 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggggttaacatgtgcaccctcatggccatagaccttggtgaattgtgtgaagacacaatcacgtacaagtgtcccctcctcaggcaaaatgaaccagaagacatagattgttggtgcaactccacgtccacatgggtaacttatggaacatgtaccaccacaggagaacacagaagggaaaaaagatcagtggcactcgttccacatgtgggcatgggactggagacacgaactgaaacatggatgtcatcagaaggggcctggaaacacgttcagagaattgaaacctggatcttgagacatccaggctttaccacaatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggtcgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaagggggcattgtaacctgtgctatgttcacatgcaaaaagaacatggaaggaaaagttgtgctgccagaaaatctggaatacaccatcgtgataacacctcactcaggagaagagcacgctgtaggcaatgatacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaactggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgatcacagttaacccaatcgcaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggccctccaccaagttttcggagcaatctatggggctgcttttagtggggtctcatggactatgaaaatcctcataggagttatcatcacatggataggaatgaattcacgtagcacctcactgtctgtgtcactagtattggtgggaatcgtgacactgtacttgggggttatggtgcaggctgacactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcactggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttttgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagttggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagaaagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattactggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgctttgatggaattaagaacaaccaaatactggaagaaaacgtggaagtggaaatctggacaaaagaaggggaaaggaagaaattaaaacccagatggttggatgctaggacctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagtaacattctggacatagatctacgtcctgcatcagcatggacgctgtatgccgtggccacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctggtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaactttagcaaaagaaggcatcaaaagaggggaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacactcaattttgcgtaaaggttctcaacccatacatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagctacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtatatgtggcttggagcacgtttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtatcaaaacaaggtggtgcgtgtacaaagaccaacaccaagaggcacagtaatggacatcatatcgagaaaagaccaaagaggcagcgggcaagtcggcacctatggccttaatacttttaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcatgctcgtggtcccatgcagaaaccaagatgaactgattggtagagcccgaatttcccagggagccgggtggtctttgaaggagacggcctgtttggggaagtcttatgcccaaatgtggaccttgatgtacttccacagacgtgacctcagactggcggcgaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 905 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggggttaacatgtgcaccctcatggccatagaccttggtgaattgtgtgaagatacaatcacgtacaagtgtcctctcctcaggcaaaatgaaccagaagacatagattgttggtgcaactccacgtccacatgggtaacttatggaacatgtaccaccacaggagaacacagaagggaaaaaagatcagtggcactcgttccacatgtgggcatgggactggagacacgaactgaaacatggatgtcatcagaaggggcctggaaacacgttcagagaattgaaacctggatcttgagacatccaggctttaccacaatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggtcgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgatcacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggccctccaccaagttttcggagcaatctatggggctgcttttagtggggtctcatggactatgaaaatcctcataggagttatcatcacatggataggaatgaattcacgtagcacctcactgtctgtgtcactagtattggtgggaatcgtgacactgtacttgggggttatggtacaggctgacactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctgaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgacaacttttcattaggagtcttgggaatggctctgttcctggaagaaatgctcaggacccgaataggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttcaccattgctcttaacatcctcacaacagaaagcggattggataccattggcattgacgataaaaggtctcaatccaacagccatttttctaacaactctctcgagaaccagcaagaaaaggagctggccgctaaatgaagctatcatggcagtcgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattactggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcaaattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgatagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagagggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgctttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggcaggtggaagggcttacaatcatgctctcagtgaactgccagagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagtaacattctggacatagatctacgtcctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaatccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcagatctacaagaaaagtggaatccaggaagtggatagaactctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacacttagagtcctcaacttagtggaaaattggctgaacaataacactcaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacccaggatgtgtaccagagaagaattcacaagaaaagtgagaagcaatgcagccttgggggccatattcactgatgagaacaaatggaaatcggctcgtgaggctgttgaagatggtaggttttgggagctggttgacagggaaagaaatcttcatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtatcaaaacaaggtggtgcgtgtacaaagaccaacaccaagaggcacagtaatggacatcatatcgagaaaagaccaaagaggcagcgggcaagtcggcacctatggccttaatacttttaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcatgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcgaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 906 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatagtggttgtgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagttgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaaactttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaatcaattgacctacgtagtcatagccatcctcacagtggtggccgcgaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacactcaattttgcgtaaaggttctcaacccatacatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagctacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttatccctatggtgacacagatggcaatgacagacacgactccatttggacaacaacgcgttttcaaagagaaagtggacacgagaacccaagaaccgaaggaaggcacaaagaaactgatgagaatcacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 907 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagccattagtgtcttgagagggtttaggaaagagattggaaggatgctgaacatcttgaataggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggattggagacacgaactgaaacatggatgtcatcagaaagggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtaacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggataaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccaccataggaatcgcactcctttctcaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtttttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagaggaaagaggatagaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggagaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacatgggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaaccggatcagcatcatctatggtgaacggagttgttaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 908 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattctactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgcggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaagcagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccctggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggattactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgttcaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtggagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagatgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtatcatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggcttcctggaaaaaaccaagaaagaccttggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaagggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatctacatcttgaagggaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaatatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagccagaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 909 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgtttaaaacagaggatggtgttaacatgtgcaccctcatggccatagaccttggtgaattgtgtgaagatacaatcacgtacaagtgccccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggctctgatcttcattttactgacagccgttgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggacgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagtgaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttttccacaaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgtgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctactatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggtttgctggtgatctcaggagtctttccagtatcgataccaattacagcagcagcatggtacctgtgggaagtgagaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccgggaccataggcgccgtatctctggacttttcccctggaacgtcaggatctccaattgtcgacagaaaaggaaaagttgtgggtctttacggtaatggtgttgttacaaggagtggagcatatgtgagtgccatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacggtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataaccctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccaattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaagcacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaataccttcaccaacatggaagcccaattaattagacagatggagggagaaggaatttttaaaagcattcagcgcctgacagtcacagaagaaatcgctgtgcagaactggttagcaagagtggggcgtgaaaggttatcaagaatggccatcagtggagatgactgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 910 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgtaggacagcaggcgtgattgttatgttgattccaacagtgatggcgttccatttaaccacacgcaatggagaaccacacatgatcgttggtaggcaggagaaagggaaaagtctcctgttcaaaacagaggatggtgttaacatgtgtaccctcatggccatagaccttggtgaattgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatagttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaacttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacaatggagtgctctccgagaacgggcctcgacttcaatgagatggtgctgctgcagatggaagacaaagcttggctggtgcacaggcaatggttcctagacctgccgttaccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtataggaaagtttaaaatcgtgaaggaaatagcagaaacacaacatggaacaatagttatcagagtacaatatgaaggggacggttctccatgcaagatcccttttgagataacagatttggaaaaaagacacgtcttaggacgcctgattacagtcaacccaatcgtaacagaaaaagatgccccagtcaacatagaagcagaacctccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctgtggtgcaggcagatagtggttgcgttgtgagctggaaaaataaagaactgaaatgtggcagcgggatcttcatcacagataacgtacacacatggacagaacaatacaagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaagggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaggaaaacttggtcaactccttggtcacagccggacatgggcagattgacaacttttcactaggagtcttgggaatggcactgttcctggaagaaatgcttaggacccgagtaggaacgaaacatgcaacactgctagttgcactatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggtcctcaaaatagtgagaaatatggaaaaataccaattggcagtgactatcatggccatttcgtgtgtcccaaatgcagtgatattgcaaaacgcatggaaagtgagttgcacaatattggcagcggtgtccgtttctccactgctcctaacatcctcacagcagaaagcggattggataccactggcattgacgataaaaggtctcaatccaacagccatttttctaacaactctctcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagatcggagccggagtttacaaagaaggaacatttcatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatatgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagctcacttcacggacccagcaagtatagctgctagaggatatatctcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatcgggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgctgtgtgacataggggaatcgtcaccaaatcccacgatagaagcaggacgaacacttagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggcacctatggccttaatactttcaccaatatggaagcccaattaattagacagatggaaggagaaggaatcttcaaaagcattcagcacctgaccgccacagaagaaatcgctgtacagaactggctagcaagagtggggcgtgaaaggctatcaagaatggccatcagtggagatgactgtgttgtaaaacccatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcctgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 911 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggagcgatcaaaaaatcaaaagctattaatgttttgagagggtttagaaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaatgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttaccgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggccggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagctgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagattgtgcatattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgcaaaccaagccacagtgctaatgggtctcgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttaattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccaggaggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 912 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgttttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtccccttctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccatagggacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccctggtagacagaggatggggaaatggatgtggattatttggaaaaggaggcattgtgacctgtgctatgtttacatgtaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttattagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaagggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtactggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcggaatggtgagcattttagccagttctctcctaaagaatgacattcccatgacaggtccattagtggctggagggcttcttactgtgtgttacgtgctcactggacggtcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgttgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctctgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttatttttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaagtatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacatcggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaacactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 913 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggagcgatcaaaaaatcaaaagctattaatgttttgagagggtttagaaaagagattggaaggatgctgaacatcttgaacaggagacgcaggacagcaggcgtgattattatgttgattccaacagcaatggcgttccatttaaccacacgtaatggagaaccacacatgatcgttggtaggcaagaaaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgttgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaagaaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgttcgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagaaattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaatagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctaattgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactgctcctgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaatgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggccggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggtttgagaacattaatcctggctcccactagagttgtggcagctgaaatggaggaagctcttagaggacttccaataagataccaaaccccagccatcagagctgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcatattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacttacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgcaaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacacaggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaattcacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccaggaggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttctcagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 914 - DNA, 10176 bp, Dengue virus; identical to SEQ ID NO: 848

SEQ ID NO: 915 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcattccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaattgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataaccctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagacgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcgcattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 916 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaagggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaagcagcaataaatcaagtcagatcccttataggcaatgaggaatacacagactacatgccatccatgaagagattcagaagggaagaggaagaggcaggtgtcctgtggtag

SEQ ID NO: 917 - DNA, 10176 bp, Dengue virus; identical to SEQ ID NO: 791

SEQ ID NO: 918 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctcttcgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggatatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaagaatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 919 - DNA, 10176 bp, Dengue virus; identical to SEQ ID NO: 792

SEQ ID NO: 920 - DNA, 10176 bp, Dengue virus; identical to SEQ ID NO: 797

SEQ ID NO: 921 - DNA, 10176 bp, Dengue virus
atgaataaccaacggaaaaaggcgagaaatacgcctttcaatatgctgaaacgcgagagaaaccgcgtgtcaactgtgcagcagctgacaaagagattctcacttggaatgttacagggacgcggaccattgaaactgttcatggccctggtggcattccttcgtttcctaacaatcccgccaacagcagggatattaaaaagatggggaacaatcaaaaaatcaaaggctatcaatgtcttgagagggttcaggaaagagattggaaggatgctgaacatcttgaacaggagacgtagaactgcaggtataattattatgatgattccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttacgggacatgcaccgccacaggagaacacagaagggaaaaaagatcagtggcactagttccacatgtgggaatgggactggagacacgaactgaaacatggatgtcatcagaaggggcctggaaacatgcccagagaattgaaacttgggtcttgagacatccaggcttcaccataatggcagcaatcctggcttacaccataggaacgacatatttccaaagagtcctgatctttatcttactgacaactgtcgctccttcaatgacaatgcgttgtataggaatatcaaatagagactttgtggaaggggtatcaggaggaagctgggttgacatagtcttggaacatggaagctgtgtgacgacgatggcaaaaaataaaccaacattggattttgaactgataaaaacagaagccaaacaccctgccactctaagaaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgttacgatggaatgctctccgagaacgggcctcgatttcaatgagatggtgttgctgcaaatggaaaacaaggcttggctggtgcacaggcaatggttcttagacctgccattaccatggctgcccggagcagacacacaaggatcaaattggatacagaaggagacattggtcactttcaaaaatccccatgcaaagaaacaggatgttgtcgttttaggatcccaagaaggggccatgcacacagcactcacaggggccacggaaatccagatgtcatcaggaaacttgctgttcacaggacatcttaagtgcaggctgagaatggacaaactacagctcaaaggaatgtcatattccatgtgcacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgtcacagaaaaagacagcccagttaacatagaagcagaacctccattcggggacagctacatcattataggagtagaaccaggacaactgaagctcagctggtttaagaaaggaagttctattggccaaatgtttgagacaacaatgagaggagcgaagagaatggccattttaggtgacacagcttgggattttggatccttgggaggggtgttcacatccataggaaaggccctccaccaagtctttggagcaatctatggggctgccttcagtggggtttcatggaccatgaaaatcctcataggagtcgtcatcacatggataggaatgaattcacgcagcacctcactgtctgtgtcactagtgttagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcttcagctatccagaaggctcatgaagaaggcatttgtggaatccgctcagtaacaagactggagaatctgatgtggagacaaataacaccagaattgaatcatattctatcagaaaatgaggtaaagttgactatcatgacaggagacattaaaggaatcatgcaggcaggaaaacgatccctgcggcctcaacccactgagctgaagtactcttggaaagcatggggcaaagcgaaaatgctttccacagagcttcacaaccacacctttctcattgatggccccgaaacagcagaatgtcccaacacaaacagagcttggaactcactagaagttgaagactatggctttggagtatttaccaccaacatatggctgaaattgaaagaaaggcaggatgtattttgtgactcaaaactcatgtcagcagccataaaagacagcagagccgtccacgccgatatgggttactggatagaaagcgcactcaatgacacatggaagattgagaaagcctcttttattgaagttaagagctgccactggccaaagtcacacactctctggagtaatggagtgctagaaagtgagatgataattccaaagaattttgcaggaccagtgtcacaacacaattacagaccaggctatcatacacaaacggcaggaccctggcatttaggcaggcttgagatggacttcgatttctgcgaaggaaccacagtggtggtgactgaggactgtggaaatagaggaccctctttaagaacaactactgcttctggaaaactcataacagagtggtgttgccgatcttgcacattaccaccgctaaggtacagaggtgaggatggatgctggtatggaatggaaattagaccattgaaagagaaagaagagaacttggtcaactctttggtcacagccggacatggacagattgataacttttcactaggagtcttgggaatggcactgttcctggaagagatgctcaggacccgaataggaacgaaacatgcaatattattagttgcagtttctttcgtgacattgatcacagggaacatgtcctttcgagatttggggagagtgatggtcatggtgggcgctactatgacggatgacataggcatgggcgtgacttatctcgccctattagcagccttcaaagtcagaccaacttttgcagctggactactcttaagaaagctgacctccaaggaattgatgatgaccaccataggaatcgtgctcctctcccagagcaccgtaccagagactatacttgaactgactgacgcgttggctttgggaatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacggcagaaagcggattggataccactggcgttgacgatcaaaggcctcaatccaacagccattttcttaacaaccctctcaagaactagcaagaaaaggagctggccactaaatgaggctattatggcagtcgggatggtgagcatcttagccagttctctcttaaagaatgatattcccatgacaggaccattagtggctggagggcttctcactgtgtgttacgtgctcactggaagatcggctgatttggaactggagagagctgctgacgtaagatgggaagaacaggcagagatatcaggaagtagtccaattctgtcgataacaatatcggaagatggtagcatgtcgataaaaaatgaagaagaagaacaaacactgaccatactcatcagaacaggactgttggtgatatcaggactttttcccgtgtcaataccaatcacggcagctgcatggtacctgtgggaagtgaaaaaacaacgagcaggagtattgtgggatgtcccttcacccccacctgtgggaaaggccgaactggaagatggagcctatagaatcaagcagaaagggattctaggatactcgcagatcggagctggagtttacaaagaaggaacatttcacacaatgtggcatgtcacacgtggtgctgtcctaatgcataaagggaagagaattgaaccatcatgggcggacgtcaagaaagatctaatatcgtatggaggaggctggaagctagaaggagaatggaaggaaggagaagaagtccaagtcctggcattagagcctggaaagaatccaagagccgtccaaacaaaacccggcctttttaaaactaacactggaaccataggcgccgtgtctctggacttttctcctggaacgtcaggatctccaatcgtcgacaaaaaaggaaaagttgtgggcctttatggcaacggtgtcgttacaaggagtggaacatatgtgagtgctatagcccagactgaaaaaagcattgaagacaatccagagattgaagatgacatctttcgaaagaaaagattgaccatcatggacctccacccaggagcaggaaaaacaaagagataccttccagcaatagtcagggaagccataaaacgaggcttgagaacactaatcttggcccccactagagttgtggcggctgaaatggaagaagctctcagaggacttccaataagataccaaaccccagctatcagagctgagcacactgggcgggagattgtggatctaatgtgtcacgccacatttaccatgaggctactgtcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccatttcctcagagcaatgcaccaatcatggatgaagaaagggaaatccctgagcgttcgtggaactctggacatgagtgggttacggattttaaagggaagactgtttggttcgttccaagtataaaagcagggaatgacatagcagcttgcctgagaaagaatggaaagaaagtgatacaactcagcaggaagacttttgattctgaatatattaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgacccactctagtgcagcacaaagaagagggagagtaggaagaaatccaaaaaatgagaatgaccagtacatatacatgggggaacctctggaaaatgacgaagactgtgcacactggaaagaagctaaaatgcttctagacaacatcaacacgcctgaaggaatcattcccagcatgttcgaaccagagcgtgaaaaggtggatgccattgatggtgaataccgcttgagaggagaagcgaggaaaactttcgtggacctaatgagaagaggagacctaccagtctggttagcctacagagtggcagctgaaggtatcaattacgcagacagaagatggtgctttgatggagtcaagaacaaccaaatcttggaagaaaatgtggaagtggaaatctggacaaaagaaggagaaaggaagaaactaaaacccagatggttggatgccaggatctactctgacccattggcgctcaaagaattcaaggaattcgcagctggaagaaagtccctgaccctgaatctaatcacagagatgggtaggctcccaaccttcatgacccagaaagcaaggaatgcactggataacttagcagtcttgcatacagctgaagcaggcggaagggcgtataatcatgctcttagtgaactgccggagactctggagacattgcttttactgacactcttggccacagtcacgggcggaatcttcctgttcttgatgagcggaaaaggtatagggaagatgaccctgggaatgtgctgcataatcacggccagtattctcctatggtatgcacaaatacagccacactggatagcagcttcaataatactggagttttttctcatagtcttgctcattccagaaccagaaaaacagagaacaccccaagataatcaattaacttatgttgtcatagccatccttacagtggtggccgcaaccatggcaaacgagatgggtttcctggaaaaaacaaagaaagatttcggattgggaagcattacaacccagcaacctgagagcaacatcctggacatagatctacgtcctgcatcagcttggactctatatgccgtggcaacaactttcatcacaccaatgttgagacatagcattgaaaattcctcagtaaatgtgtctctaacagccattgccaaccaagccacagtgttaatgggtcttgggaaaggatggccattgtcaaaaatggacatcggagttccccttctcgctatcgggtgctattcacaagtcaaccccataactctcacagcagcccttctcctattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgtgtgactcaagtattgatgatgaggactacatgggccttatgtgaagctctaaccttagcaaccgggcccatctctacactgtgggaaggaaatccaggaagattctggaatacaactattgcagtgtcaatggctaacatttttagagggagttacctggccggagccggacttctcttttctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaactgaccatcacgctgtgtcgcgaggctcggcgaaactgagatggttcgtcgagagaaacctggtcacaccagaagggaaagtagtggaccttggttgtggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgttttctttactccgccagaaaagtgtgacacattgctgtgtgacataggggagtcgtcaccaaaccccacggttgaagcaggacggacactcagagttttaaacttagtggaaaattggctgaacaataacacccaattttgcataaaggttctcaacccatatatgccctcagttatagaaaaaatggaagcgctacaaaggaaatacggaggagctttggtgaggaatccactctcacgaaattccacacacgagatgtactgggtgtccaatgcttccgggaacatagtgtcatcagtgaatatgatttcaagaatgttgattaacagattcacaatgagacacaagaaggccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgttatccctatggtgacacagatggcaatgacagacacgactccatttggacaacagcgtgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagtaatgcagccttaggcgccatattcactgatgagaacaagtggaagtcggcacgtgaggctgttgaagacagtggattttgggaattggttgacaaggaaaggaatctccatcttgaaggaaagtgtgagacatgtgtatataacatgatgggaaagagagagaagaagctaggggagttcggcaaagcgaaaggcagcagagccatatggtacatgtggcttggagcacgcttcttagagtttgaagccctaggattcttgaatgaagatcactggttttccagagagaactccctgagtggagtggaaggagaagggctgcacaaattaggctacattttaagagacgtgagtaagaaagaaggaggagcaatgtacgccgatgacaccgcaggatgggatacaagaatcacactagaggatttgaaaaatgaagaaatggtgacaaaccacatggaaggagaacacaagaaacttgctgaagccatcttcaaattaacgtaccaaaacaaggtggtgcgcgtgcaaagaccaacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcaactgacagtcacagaagaaattgcagtgaaaaactggttagcaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcctttttgttcacaccatttccatgagttaatcatgaaggacggtcgtgtactcgtagttccatgcagaaatcaagatgaactgattggtagggcccgaatttcccagggagccgggtggtccatgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaaggtttagaagagaagaggaagaggcaggagtcttgtggtag

SEQ ID NO: 922 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaattaaaaaatcaaaagccattaatgttttgagagggttcaggaaagagatcggaaggatgctgaacatcttgaataggagacgcaggtctgcaggcatgatcattatgctgattccaacagtaatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccattacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttagaacatggaagttgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagagaacttggaatacaccattgtggtaacacctcactcaggggaggagcatgcggtcggaaatgacacaggaaaacacggcatggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggttactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggataagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatctggaaaaaagatatgtcttaggccgcctaatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcatcatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattaaatcacattctagcagaaaatgaggtgaagttgactattatgacaggagacatcagaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggctataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcgggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatatagaggtgaggatgggtgctggtacgggatggaaatcagaccgttgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagtatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggaacctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtctgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggatttttatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaaccgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaggaaggggaaagaaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccttagagacactgcttttactgacacttctggccacagtcacaggagggatctttttattcttgatgagcgggaggggcatagggaagatgaccctgggaatgtgctgcataatcacggctagcatccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacacagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcctataactctcacagcagccctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaagaagtggataggaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacgtcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccaaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccaccttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggtacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtatacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacatgccaaacatgaatggatgacaacggaagacatgttgacagtctggaacagggtgtggattcgagaaaacccatggatggaagacaaaactccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 923 - DNA, 10176 bp, Dengue virus
atgaataaccaacggaaaaaggcgaaaaatacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaattaaaaaatcaaaagccattaatgttttgagagggttcaggaaagagatcggaaggatgctgaacatcttgaataggaggcgcaggtctgcaggcatgatcattatgctgattccaacagtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgcaaaatcccttttgagataatggatttggaaaaaagatatgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctccttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgtttttgaattgactgatgcgttagccttaggcatgatggtccttaaaatagtaagaaacatggaaaagtatcaattagcagtgactatcatggccatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcagggagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaagggaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgaatgggtcacggattttaaagggaagactgtttggttcgttccaagcataaaagcaggaaatgatatagcagcttgcctgagaaaaaatggaaagaaagtaatacaacttagtaggaagacttttgattccgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctttggaaaatgatgaagactgtgcacactggaaagaagccaaaatgctcctagataacattaacacaccagaaggaatcattcctagtatgtttgaaccagagcgtgaaaaagtggatgccatcgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaatatcctggacatagacctacgccccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacttgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttggcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgatacattgttgtgtgacataggggagtcatcgccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatctaatgcttctgggaacatagtgtcatcagtgaacatgatttcaaggatgttgatcaatagattcacaatgagacacaagaaagccacttacgaaccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaattaatgaaaatcacagcagagtggctatggaaagaattagggaagaaaaagacacctaggatatgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactgacgtatcaaaacaaggtggtgcgtgtgcaaagaccaacaccaagaggaacagtaatggacatcatatcgagaaaagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtgcttgttgttccatgtagaaaccaagatgaactgattggcagagcccgaatctcccaaggagcagggtggtctttgcgggagacggcctgtttggggaagtcctacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcaagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 924 - DNA, 10176 bp, Dengue virus
atgaataaccaacgaaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaattaaaaaatcaaaagccattaatgttttgagagggttcaggaaagagatcggaaggatgctgaacatcttgaataggagacgcaggtcggcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagccgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgctggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatgaaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgtacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcgaagagaatggccattttgggtgacacagcctgggactttggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcataacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacgacagagtgccctaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgctgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacacgagtaggaacgaaacatgcaatactactagttacagtttcttttgtgacattgatcacagggaacatgtccttcaaagacctaggaagagtggtggtcatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcttacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatttaatatcatatggaggaggctggaagctagaaggagaatggaaggaaggagaagaagtccaggtgttggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttacggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagctatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagctactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagccgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagttacaggagggatttttttattcttgatgagcgggaggggcatagggaagatgaccctgggaatgtgctgcataatcacggctagcatccttctatggtacgcacaaatacagccacactggatagcagcttcaataatactggagttttttctcatagttttgctcattccagaaccagaaaaacagagaacaccccaagacaaccaattgacctacgttgtaatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgttgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaacgtaagagaagtgaaaggcctaacaaaaggaggaccaggacacgaagaacccatccctatgtcaacatatgggtggaatctggtgcgtcttcagagtggagttgacgtctttttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagttatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggctacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtctatacacgccaaacatgaatggatgacaacggaagacatgttgacagtctggaacagggtgtggattcgagataacccatggatggaagacaaaaccccagtggaatcatgggaggaaatcccatacttgggaaaaagagaagaccaatggtgcggctcattgattgggttaacaagtagggccacatgggcaaagaacatccaagcagcaataaatcaggttagatctcttatgggcaatgaggaatacacagattacatgccatccatgaaaagattcagaagagaagaggaagaagcaggagtcctgtggtaa

SEQ ID NO: 925 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaatcaaaaaatcaaaagccattaatgttttgagagggttcaggaaagagatcggaaggatgctgaacatcttgaacaggaggcgcaggtctgcaggcatgatcattatgctgattccaacagtgatggcgttccatctaaccacacgcaacggagaaccacacatgatcgtcggtatacaggagaaaggaaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccattgggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgtaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccattacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcacacagcactcacaggagccacagaaatccaaatgtcgtcaggaaacttgctcttcactggacatctcaagtgtaggctgagaatggacaagctacagcttaaaggaatgtcatactccatgtgcaccggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccgaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtacgggcgtgacttatcttgccctactagcagccttcaaagttagaccaacttttgcagctgggctactcttgagaaagctgacctccaaggaattgatgatgactaccataggaattgtactcctctctcaaagtactataccagagaccgttcttgaattgactgatgcgttagccttaggcatgatggtccttaaaatagtaagaaacatggaaaagtatcaattagcagtgactatcatgactatcttgtgcgtcccaaacgcagtgatattacaaaatgcatggaaagtgagttgcacaatactggcagtggtgtccgtctccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcggcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcacacaatgtggcatgtcacacgtggcgctgttctaatgcataaaggaaagaggattgaaccttcatgggcggacgtcaaaaaagatctaatatcatatggaggaggctggaagctggaaggagaatggaaggaaggagaagaagtccaggtgctggcactggagcctggaaaaaatccaagagccgttcaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtagaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagcgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttgccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctaggaaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaataacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacaaatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgcagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 926 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaatcaaaaaatcaaaagccattaatgttttgagagggttcaggaaagagatcggaaggatgctgaacatcttgaataggaggcgcaggtctgcaggcatgatcattatgctgattccaacagtgatggcgttccatctaaccacacgcaacggagaaccacacatgatcgtcggtatacaggagaaaggaaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccattgggacgacacatttccagaaagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgtaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccattacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcacacagcactcacaggagccacagaaatccaaatgtcgtcaggaaacttgctcttcactggacatctcaagtgtaggctgagaatggacaagctacagcttaaaggaatgtcatactccatgtgcaccggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccgaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtacgggcgtgacttatcttgccctactagcagccttcaaagttagaccaacttttgcagctgggctactcttgagaaagctgacctccaaggaattgatgatgactaccataggaattgtactcctctctcaaagtactataccagagaccgttcttgaattgactgatgcgttagccttaggcatgatggtccttaaaatagtaagaaacatggaaaagtatcaattagcagtgactatcatgactatcttgtgcgtcccaaacgcagtgatattacaaaatgcatggaaagtgagttgcacaatactggcagtggtgtccgtctccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcggcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcacacaatgtggcatgtcacacgtggcgctgttctaatgcataaaggaaagaggattgaaccttcatgggcggacgtcaaaaaagatctaatatcatatggaggaggctggaagctggaaggagaatggaaggaaggagaagaagtccaggtgctggcactggagcctggaaaaaatccaagagccgttcaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtagaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagcgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttgccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctaggaaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggattaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacaaatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatacttttaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgcagaaaccaagatgaactgattggcagagcccgaatctcccaaggagcagggtggtctttgcgggagacggcctgtctggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcgggagtcctgtggtaa

SEQ ID NO: 927 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaattaaaaaatcaaaagccattaatgttttgagagggttcaggagagagatcggaaggatgctgaacatcttgaataggaggcgcaggtctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaataaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcatctgcaaacactccatggtagacagaggatggggaaatggatgtggactatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagttacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtacttgggagtcatggtgcaggccgatagtggttgcgttgtgagctggaaaaacaaagaactgaaatgtggcagtgggattttcatcacagacaacgtgcacacatggacagaacagtacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctcattcattgaggtaaaaaactgccactggccaaaatcacacaccctctggagtaacggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaatatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggagggggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctagacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggaaatgggtgaggcagctgggattttcatgacagccactcccccgggaagtagagatccattccctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaggtggatgccattgatggcgaataccgtttgagaggagaagcaaggaaaacatttgtggacttgatgaggagaggagacttaccagtttggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataaccacggctagcatccttctatggtacgcacaaatacagccacactggatagcagcctcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcctgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagagaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtgagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatacatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgctcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 928 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaattaaaaaatctaaagccattaatgttttgagagggttcaggaaagagatcggaaggatgctgaacatcttgaacaggagacgcaggtctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgatattcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatgaaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttctaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaatatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaatgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattttagcggaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaagctcatgtcggcggccataaaagacaacagagccgtccatgccgacatgggttactggatagaaagtgcactcaatgacacatggaagatagagaaagcctctttcattgaagtaaaaaactgtcactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctcaggaaaactcataacagaatggtgctgccgatcttgcacactaccacccctaagatacagaggtgaagatgggtgctggtacgggatggaaatcagaccattgaaagagaaagaagaaaatctggttaactccttggtcacagccggacatgggcaggttgacaatttttcactgggagtcttgggaatggcattgttcttggaggaaatgcttaggacccgagtaggaacgaaacatgcaatactactagttgcagtttcttttgtgacactgatcacagggaacatgtccttcaaagacctaggaagagtggtggttatggtaggcgctacaatggcggatgatataggcatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagctatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggtgctgtcctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaattatcgacaaaaaaggaaaagttgtgggtctttatggtaatggtgttgtcacaaggagtggagcatatgtaagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccacccccccaggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaatatcgtttgagaggagaagcaaggaaaacctttgtggacttaatgaggagaggagacttaccagtctggttggcttacaaagtggcagctgaaggcatcaactatgcagacagaaggtggtgttttgatgggattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactccttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaactgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgtcacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaatccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggctttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagacctacaagaaaagtggaatccaggaagtggatagaaccttagcaaaagaaggcatcaaaagaggagaaacggaccatcacgctgtgtcgcgaggctcggcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaagctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaaggccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggaaacggcctgtttggggaagtcttacgcccaaatgtggagcttgatgtatttccacaggcgtgacctcaggctggcggcaaatgccatttgctcagcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgtggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 929 - DNA, 10176 bp, Dengue virus
atgaataaccaacggaaaaaggcgagaagtacgcctttcaatatgctgaaacgcgagagaaaccgcgtgtcgactgtgcaacagttgacaaagagattctcacttggaatgctgcaaggacgaggaccgttaaaactgttcatggcccttgtggcgttccttcgtttcctaacaatcccaccaacagcagggatactgaaaagatggggaacgatcaaaaaatcaaaagctattaatgttttgagagggttcaggaaagaaattggaaggatgctgaacatcttgaacagaagacgcaggacagcaggcgtgattattatgttgattccaacagcgatggcgttccatctaaccacacgtaatggagaaccacacatgatcgttggtagacaagagaaagggaaaagtcttctgttcaaaacggaggatggtgtgaacatgtgtaccctcatggccatagatcttggtgaattgtgtgaagatacaatcacgtacaagtgccccctcctcaggcagaatgaaccagaagacatagattgttggtgtaactccacgtccacatgggtaacttatgggacgtgcaccaccacaggagaacacagaagagaaaaaagatcagtggcactcgttccacatgtgggtatgggactggagacacgaactgaaacatggatgtcgtcagaaggagcctggaaacacgctcagagaattgaaacctggatcttgagacatccaggctttaccataatggcagcaatcctggcatacaccataggaacgacacatttccaaagggccctgattttcatcttactgacagctgtcgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaacagaagccaaacaacctgccactttaaggaagtactgtatagaagcaaagctgaccaacacaacaacagaatctcgttgcccaacacaaggggaacccagtctaaatgaagagcaggacaaaaggttcgtctgcaaacactccatggtggacagaggatggggaaatggatgtggattatttggaaagggaggcatcgtgacctgtgctatgtttacatgcaaaaagaacatggaaggaaaaatcgtgcagccggaaaatttggaatacaccatcgtgataacaccccactcaggagaagagcatgctgtaggtaatgacacaggaaaacatggtaaggaaatcaaaataacaccacagagttccatcacagaagcagaactgacaggctatggcacagttacgatggagtgctctccgagaacgggccttgactttaatgagatggtgctgctgcagatggaagacaaagcttggctggtgcacaggcagtggttcctagacctgccgttaccatggctacccggagcggacacacaaggatcaaattggatacagaaagagacactggtcaccttcaaaaatcctcacgcgaagaaacaggatgtcgttgttttaggatctcaagaaggggccatgcacacggcactcacaggggccacagagatccagatgtcatcaggaaacttactattcacaggacatctcaagtgcaggctgagaatggacaaactacagctcaaaggaatgtcgtactctatgtgcacaggaaagttcaaaattgtgaaggaaatagcagaaacacaacatggaacaatagttattagagtacaatatgaaggagacggctctccatgtaagatcccttttgaaataatggatttagaaaaaagacatgttttaggtcgcctgattacagttaacccgatcgtaacagaaaaagatagcccagtcaacatagaagcagaacctccattcggagacagctacatcattataggagtagagccgggacaattgaaactcaactggtttaagaaaggaagttccattggccaaatgtttgagacaacaatgagaggagcgaagaggatggccatcttaggtgacacagcctgggattttggatccctaggaggagtgtttacatctataggaaaagctctccaccaagttttcggagcaatctatggggctgcctttagtggggtctcatggactatgaaaatcctcataggagccatcatcacatggataggaatgaattcacgtagcacctcactgtctgtgtcactagtattggtgggagtcataacactgtacttgggagccatggtgcaggctgatagtggttgcgttgtgagctggaaaaacaaagaactgaaatgtggcagcgggatcttcatcacagataacgtgcacacatggacagagcaatacaagttccaaccagaatccccttcaaaattagcttcagctatccagaaagctcatgaagagggcatttgtgggattcgttcagtaacaagattggagaatctgatgtggaaacaaataacaccagaattgaaccacattctatcagaaaatgaggtaaagttgaccatcatgacaggagatattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggctttggagttttcaccaccaacatatggctaaaattgagagaaaaacaggatgtgttttgtgactcaaaactcatgtcagcagccataaaagacaacagagccgtccatgccgatatgggttactggatagaaagtgcactcaatgacacatggaagatggaaaaggcctccttcattgaagttaaaagctgccactggccaaagtcacacaccctctggagcaatggagtattagaaagtgagatgataattccaaaaagttttgctgggccagtgtcacaacacaactacagaccaggctattacacgcaaacagcaggaccttggcatctaggtaagctcgaaatggactttgatttctgcgaaggaactacagtggtggtgactgaggactgcggaaatagaggaccctctttaagaacgaccactgcctctggaaaacttataacagaatggtgctgccgatcctgcacattaccacctctaagatacagaggtgaggatggatgctggtatgggatggaaatcagaccattaaaagagaaagaagagaatttggtcaactccttggtcacagcaggacatgggcagattgacaacttctcactaggagtcttgggaatggcactattcttggaagaaatgctcaggacacgagtaggaacgaaacatgcaatactgctagttgcagtttcctttatgacattgattactgggaacatgtcctttagagacctgggaagagtgatggttatggtgggcgctaccatgacggatgacataggtatgggagtgacttatcttgccctactggcagctttcaaagttagaccaacttttgcagctggactactactgagaaagctgacctccaaggaattaatgatggctaccataggaattgcactcctttctcaaagcaccataccagagaccattcttgaactaactgatgcgttagccttgggcatgatggtcctaaaaatagtgagaaatatggaaaagtaccaattggcagtgactatcatggctatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatctttctaacaactctttcgagaaccagcaagaaaaggagctggccactaaatgaggctatcatggctgtcgggatggtgagcattttagccagttccctcttaaaaaatgacattcccatgacaggtccattagtggctggagggctccttactgtgtgctacgtgctcactggacgatcggccgatttggaactggagagagccaccgatgtcaaatgggaagatcaggcagaaatatcaggaagcagcccaatcctgtcaataacaatatcagaagatggcagcatgtcgataaagaatgaagaggaagaacaaacactgaccatactcatcagaacgggattgctagtgatctcaggactctttccagtgtcaataccaattacggcagcagcatggtacctgtgggaagtgaagaaacaacgggctggagtattgtgggacgtcccttcacccccacccgtgggaaaggctgaactggaagatggagcctatagaatcaagcagaaagggattcttggatactcccagattggagccggagtttacaaagaaggaacattccatacaatgtggcacgtcacacgtggcgctgttctgatgcatagagggaagaggattgaaccatcatgggcggacgtcaagaaagacctaatatcatatggaggaggctggaaactcgaaggagaatggaaggaaggagaggaagtccaagtcctggcattggaacctggaaaaaatccaagagctgttcaaacgaaacctggacttttcaaaaccaacaccggaaccataggcgccgtatctctggacttttctcctggaacgtcaggatccccaattgtcgacagaaaaggaaaagttgtgggtctttatggcaatggtgttgtcacaaggagtggagcatacgtgagtgctatagcccagaccgaaaaaagcattgaagacaatccagagattgaagatgacattttccgaaagaaaagattgactatcatggacctccatccaggagcgggaaagacaaaaagataccttccagccatagttagagaggccataaaacgtggcttaagaacattaatcctggcccccactagagtcgtggcagctgaaatggaggaagctcttagaggacttccaataagataccaaaccccagccatcagagccgagcacaccgggcgggagattgtggacctaatgtgtcatgccacgtttactatgaggctgctatcaccagtcagagtgccaaattacaacctgatcatcatggatgaagctcacttcacagacccagcaagcatagcagctagaggatacatttcaactcgagtagagatgggtgaagcagctgggattttcatgacagccactcctccgggaagtagagacccatttcctcagagcaatgcaccaatcatagatgaggaaagagaaatccctgagcgttcgtggaactctggacatgaatgggtcacggattttaaagggaagactgtttggtttgttccaagtataaaagcgggaaatgacatagcagcttgtctcaggaaaaatggaaagaaagtgatacaactcagcaggaagacctttgactctgagtatgttaagactaggaccaatgattgggactttgtggtcacaaccgacatttcagaaatgggtgctaacttcaaggctgagagggttatagaccccagacgttgcatgaaaccagttatactaacagatggtgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcgcattggaaagaagctaaaatgctcctagataacatcaacacacctgaaggaatcattcctagtatgttcgaaccagagcgtgaaaaggtggatgccattgatggtgaataccgcttgagaggagaagcaaggaaaacctttgtggacctaatgagaagaggggacttaccagtctggctggcctacagagtggcagctgaaggcatcaactacgcagacagaaggtggtgttttgatggagttaagaataaccaaatactggaagaaaacgtggaagtggaaatttggacaaaagagggggaaaggaagaaattaaaacccagatggttggacgctaggatctattctgacccactggcactaaaagaattcaaggaatttgcagctggaagaaagtccctaaccctgaacctaatcacagaaatgggtaggcttccaactttcatgactcaaaaagcaagagatgcactggataacctagctgtgctgcatacggctgaggcaggtggaagagcgtacaatcatgctctcagtgaactgccggagaccctggagacactgcttttactgacacttctggctacagtcacgggaggaatcttcttattcttaatgagcggaaaaggtgtagggaagatgaccctgggaatgtgctgcataatcacggctagcatcctcctatggtatgcacagatacaaccacactggatagccgcttcaataatattggagttttttctcatagttttgctcattccagaaccagaaaaacagagaacaccccaagataaccaattgacctacgttgtcatagccatcctcacagtagtggccgcaaccatggcaaacgaaatgggttttctggaaaaaaccaagaaagacctcggactgggaagcattgcaactcaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttcccctccttgccattggatgttactcacaagtcaaccccataactctcacagcagctcttcttttattgatagcacattatgccattatagggccaggacttcaagcgaaagcaaccagagaagctcagaaaagagcagcagcaggcatcatgaaaaacccaacagtcgatggaataacagtgatcgacctagatccaataccctatgatccaaaatttgaaaaacagttaggacaagtaatgctcctaattctctgcgtgactcaagtattaatgatgaggactacatgggctctgtgtgaggctctaaccttagcgaccgggcccatctccacattgtgggaaggcaatccagggaggttttggaacactaccattgcagtgtcaatggctaacatttttagagggagctacttggctggagctggacttcttttttccatcatgaagaatacaacaaatacaagaagaggaactggcaacataggagagacgcttggagagaaatggaaaagccgattgaacgcactgggaaaaagtgaatttcagatttacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgtggtagagggggctggtcatactattgtgggggactaaagaatgtaagagaagtcaaaggcctgacaaaaggaggaccaggacacgaggaacctatccccatgtcaacatatgggtggaatctagtacgtctgcagagtggagttgatgttttcttcactccgccagaaaagtgtgacacactgttgtgtgacataggggagtcgtcaccaaatcccacgatagaagcaggacgaacactcagagtcctcagcttggtggaaaattggttgaacaatgacactcaattttgcataaaggttctcaacccatacatgccctcagttatagaaaaaatggaaacactgcagaggaaatatggaggagccttagtgaggaatccactctcacgaaactccacacatgagatgtactgggtatccaatgctactggaaacatagtgtcatcagtgaacatgatttcaaggatgctgattaacagattcacaatgaaacacaagaaagccacctacgagccagatgttgacctagggagcggaacccgcaacattggaattgaaagtgagataccaaatctagacataataggaaagagaatagagaaaataaagcaagagcatgaaacatcatggcactatgaccaagaccacccatataaaacatgggcttaccatggcagctatgaaacaaaacagactggatcagcatcatccatggtgaacggagtggtcagactactgacaaaaccttgggacgtcgtccctatggtaacacagatggcaatgacagatacgaccccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggagccatattcactgatgagaacaaatggaagtcggcacgcgaggctgttgaagatagtaggttttgggagctggttgacaaggaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcttggagtttgaagccctgggattcttgaatgaagatcactggttctctagagagaactccctgagtggagtggaaggagaagggctgcacaagctaggctacattctaagagacgtgagcaagaaggaaggaggagcaatgtacgctgatgatacagcaggatgggacacaagaatcacactagaggacttaaaaaatgaagaaatggtgacaaaccacatggaaggagaacacaagagactagccgaggccatatttaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaattttcaaaagcattcagcacctgacagtcacagaagaaatcgctgtacagaactggttggcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccttcaaaaggatggaacgattggacacaagtgcctttctgttcacaccattttcatgagttaatcatgaaagacggccgcgtgcttgtggttccatgcagaaaccaagatgaactgattggcagggcccgaatttctcagggagctgggtggtctttgaaggagactgcctgtttggggaagtcttacgcccaaatgtggagcctgatgtacttccacagacgtgacctcaggctggcggcaaatgctatttgctcggcagtcccgtcacattgggttcctacaagtcgaacaacctggtctatacacgccaaacatgaatggatgacgacggaagacatgctgacagtctggaacagggtgtggatccaagaaaacccatggatggaagacaaaactccagtggagtcatgggaggaagtcccatatttgggaaaaagagaagaccaatggtgcggctcattgattgggctaacaagcagggctacctgggcaaagaacatccaaacagcaataaatcaagtcagatcccttataggcaatgaagaatacacagattacatgccatccatgaagagattcagaagggaagaggaagaggcaggtgtcctgtggtag

SEQ ID NO: 930 - DNA, 10176 bp, Dengue virus
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaattaaaaaatcaaaagccattaatgttttgagagggttcaggaaagagatcggaaggatgctgaacatcttgaataggagacgcaggtctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctatcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccactctaaggaagtactgcatagaagcaaagttaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcgaattggatacagaaagaaacattggtcactttcaaaaatccccatgcgaagaaacaggatgttgttgttttaggatcccaagaaggggccatgcatacagcactcacaggagctacagaaatccaaatgtcgtcaggaaacttgctcttcactggacatctcaagtgcaggctgagaatggacaagctacagcttaaaggaatgtcatactccatgtgcacaggaaagttcaaagttgtgaaggaaatagcagaaacacaacatggaacgatagtcatcagagtgcaatatgaaggggacggctctccatgtaaaatcccatttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccaccgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtatgggatggaaatcagaccattgaaagagaaagaagaaaatctggttaactccttggtcacagccggacatgggcaggttgacaatttttcactaggagtcctgggaatggcattgttcctggaagaaatgcttaggacccgagtaggaacgaaacatgcaatactactagttgcagtttcttttgtgacattgattacagggaacatgtccttcaaagacctaggaagagtggtggttatggtaggcgctacaatggcggatgacataggtatgggcgtgagttatcttgccctactagcagccttcaaagttagaccaacctttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtggtattacaaaatgcatggaaagtgagttgcacaatactggcagtggtgtccgtttccccactgctcttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcagacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacacaggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcaaagctgagcacactgggcgggaaattgtggatctaatgtgtcatgccacatttaccatgaggctgctatcaccagttagagtgccgaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagaccgtttggttcgttccaagcataaaagcaggaaatgatatagcagcttgcctgagaaaaaatggaaagaaagtaatacaactcagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagcatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaataaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactaacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacattggagtcccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccctatgatccaaagtttgaaaagcagttgggacaagtaatgctgctaatcctctgcgtgactcaagtattaatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccattcctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtggaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagatcacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaagttaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaactaatcagacagatggaaggagaaggagtctttaaaaacatccagaacctgacagtcacagaagaagttgccgtgcaaaactggttggcaagagtggggcgcgaaaggttgtcaagaatggccatcagtggagatgattgtgttgtgaaacctttagatgacaggttcgcaaacgctctgacagccctaaatgacatgggaaagattagaaaagatatacaacaatgggaaccttcaaaaggatggaatgattggacacaagtgcctttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcggacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 931 - DNA, 10176 bp, Dengue virus
atgaataaccaacggaaaaaggcgaaaaatacgcctttcaatatgctgaaacgcgagagaaaccgcgtgtcgactgtgcaacagctgacaaagagattctcacttggaatgctgcagggacgaggaccattaaaactgttcatggccctggtggctttccttcgtttcctaacaatcccaccaacagcagggatattgaagagatggggaacaattaaaaaatcaaaagccattaatgttttgagagggttcaggaaagagatcggaaggatgctgaacatcttgaataggaggcgcaggtctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctgcagcttaaaggaatgtcatactccatgtgcacaggaaagtttaaagttgtgaaggaaatagcagaaacacaacatggaacgatagtcatcagagtgcaatatgaaggggacggctccccatgcaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcatcatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagtcgcagtttcttttgtgacattgatcacagggaacatgtccttcaaagacctaggaagagtggtggttatggtaggtgctacaatggcggatgacataggtatgggcgtgacttatcttgccctactagcagcctttaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtaagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagacctaatatcatatggaggaggctggaagctagaaggagaatggaaggaaggagaagaagtccaggtgctggcactggagcctggaaaaaatccaagagccgtccaaacaaaaccaggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacatttttcgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgacatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtctgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttctttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagctgggacaagtaatgctactaatcctctgcgtgactcaagtattgatgatgaggactacatgggctctgtgtgaggccttaaccttagctacagggcccatctccacactgtgggaaggaaatccaggaaagttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacacactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggtttgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttatgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgttctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgagagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagatcaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 932 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacttccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcctctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggaatcttaggaatggcactgttcctggaagaaatgcttaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtcttaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggccacaacatttgtcacaccaatgttgagacatagcattgaaaattcctcagtgaatgtctccctaacagctattgctaaccaagccacagtgctaatgggtcttgggaaaggatggccattgtcaaagatggacattggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttatcatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaagagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 933 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcagggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggtgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgccatgtttacatgcaaaaagaacatggaaggaaaagtcgtgcagccagaaaacttggagtacaccatcgtgataacaccacactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctaagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagccatccaaaaagctcatgaagagggcatttgtggaatccgctcagtaacaagattggagaatctgatgtggaaacaaataacaccagaattgaatcatattctatcagaaaatgaggtaaaattgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatggtaatcccaaaaaattttgccgggccagtgtcacaacacaactacagaccaggctaccatacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaattgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagtccaatcctgtcaataacgatatcagaagatggcagcatgtcgataaaaaatgaagaggaagaacaaacactgaccatacttatcagaacgggattgttggtgatctcaggagtctttccagtatcgataccaatcacggcagcagcatggtacctgtgggaagtaaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgatcagtacatatacatgggggaaccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggaaaccctggagacactgcttctactgacactcctggcaacagtcacaggaggaatcttcttattcttaatgagtggaaaaagtatagggaagatgaccctgggaatgtgttgcataatcacggctagcatcctcctatggcatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggatatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctctttgccattggatgctattaccaagtcaaccctataactctaacagcagctcttcttctattggtagcacataatgccattataggccaaggactacaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtgatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcgacatatgggtggaatctagtgcgtctgcaaagtggagttgacgttttcttcaccccgccggaaaagtgtgacacattgctgtgtgacataggggagtcgtcaccaaaccccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgatcaacagattcacaatgaaacacaagaaagccacttacgagccagatgttgacctaggaagtggaacccgcaacattggaattgaaaatgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggtaatgaggaatacacagattacatgccatccatgaagagattcagaagggaagaggaagaggcaggtgtcctgtggtag

SEQ ID NO: 934 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccgcatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaacacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaagaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagttcaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcattgtctgtgtcactagtattggtgggagtcgtgacactgtacttgggagttatggtgcaggctgatagcggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagactctcacaatcagacctttcttattgatggccctgaaacagcagaatgccccaacacaaacagagcttggaactcactggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttctcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgccaccatgacggatgacataggtatgggagtgacttaccttgccctactagcagctttcaaagttagaccaacttttgcagctggactactcttgagaaaactgacctccaaggaactaatgatggccaccataggaatcgcacttctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagatgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgacggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccgcagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagcccttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactagggaagaaaaagacacctaggatgtgtaccagagaagaatttgcaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaaggactgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 935 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttactataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgattaaaacagaagccaaacaacctgccactctaaggaagtactgtatagaagcaaagctgaccaatacaacaacagaatctcgttgtccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggccttgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcggcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagactattcttgaactaactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcacagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcatcgaaaattcctcagtgaatgtctccctaacagccattgctaaccaggccacagtgctaatgggtcttgggagaggatggccattgtcaaagatggacatcggagttcccctccttgccattggatgctattcacaagtcaaccctataactctcacagcagcccttcttttgctggtagcacattatgccattatagggccaggacttcaagcaaaagcaaccagagaagctcagaaaagagcagcagcgggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaatgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcatccctatggtgacacagatggcaatgacagacacgactccatttggacaacaacgcgttttcaaagagaaagtggacacgagaacccaagaaccgaaggaaggcacaaagaaactaatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcggacaagtcggcacctatggccttaatactttcaccaacatggaagcccaattaattagacagatggagggagaaggaatttttaaaagcattcagcacctgacagtcacagaagaaatcgctgtacagaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaagccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccatggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacatagactacatgccatccatgaagagattcagaaaggaagaggaagaggcaggtgtcctgtggtag

SEQ ID NO: 936 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcatgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgtccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaattgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattagaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagactattcttgaactgactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtggaaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggagttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaaccgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcacgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctacgtagtcatagccatcctcacagtggtggccgcaaccatggcaaatgagatgggtttcctggaaaaaactaagaaagacctcggattgggaagcattataacccaggaatctgagagcaacatcctggacatagatctacgtcctgcatcagcatggacgctgtatgccgtggctacaacatttgtcacaccaatgttgagacatagcatcgaaaattcctcagtgaatgtctccctaacagccattgctaatcaggccacagtgctaatgggtcttgggagaggatggccattgtcaaagatggacatcggagttcccctccttgctattggatgctattcacaagtcaaccctataactctcacagcagcccttcttttgctggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtagacacgagaacccaagaaccgaaggaaggcacaaagaaactaatgagaattacggcagagtggctttggaaagaactaggaaagaaaaagacacctaggatgtgtaccagagaagaatttacaagaaaagtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacattagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacggaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcgcattgggttccaacaagtcgaacaacctggtccatacacgctaagcatgaatggatgacgacggaagacatgctggcagtctggaacagggtgtggatccaagaaaacccatggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 937 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtatttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagttagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaattattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcatcacaacccaggaatctgagagcaacattctggacatagatctacgtcctgcatcagcatggacgctgtatgccgtggctacaacatttgtcacaccaatgttgagacatagcattgaaaattcctcagtgaatgtctccttaacagccattgctaaccaagccacagtgctaatgggtcttgggagaggatggccattgtcaaagatggacattggagttcccctccttgccattggatgctattcacaagtcaaccctataactctcacagcagctcttcttctactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtatcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactgggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttctcagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgatcgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctatggtag

SEQ ID NO: 938 - DNA, 10176 bp, Dengue virus
atgaataaccaacggaaaaaggcgagaagtacgcctttcaatatgctgaaacgcgagagaaaccgcgtgtcaactgtgcaacagctgactaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagtaatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgccccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggctctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagatctgccgttaccatggctacccggagcggacacacaaggatcaaattggatacagaaagagacgttggtcactttcaaaaatccccacgcgaagaaacaggacgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttagaaaaaagacacgtcctaggtcgcctgattacagtgaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttttccacaaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcgcacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgtgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctactatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggtttgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcttatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgccatagcccagaccgaaaaaagcattgaagacaatccagagatcgaagatgacattttccgaaagaaaagattgaccatcatggatctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagctcacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatcgggaagatgaccctgggaatgtgttgtataatcacggctagtatcctcctatggtatgcacagatacaaccacactggatagcagcttcaataatactggagttttttctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaataaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgctgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaagcacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagagatcgctgtgcagaactggttagcaagagtggggcgtgaaaggttatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggagtcctgtggtag

SEQ ID NO: 939 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggggttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatggaacatgtaccaccacaggagaacacagaagggaaaaaagatcagtggcactcgttccacatgtgggcatgggactggagacacgaactgaaacatggatgtcatcagaaggggcctggaaacacgttcagagaattgaaacctggatcttgagacatccaggttttaccacaatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgattaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggcaatgatacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaactggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgatcacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggactttggatccctgggaggagtgtttacatctataggaaaggccctccaccaagttttcggagcaatctatggggctgcttttagtggggtctcatggactatgaaaatcctcataggagttatcatcacatggataggaatgaattcacgtagcacctcactgtctgtgtcactagtattggtgggaatcgtgacactgtacttgggggttatggtgcaggctgacactggttgcgttgtgagctggaaaaataaagaactgaaatgtggcagcgggatcttcattacagataacgtgcacacatggacagaacaatacaagttccaaccagaattcccttcaaaactagcttcagctatcaagaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcactggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtatgggatggaaatcagaccattgaaagagaaagaggagaatctggtcaactccttggtcacagccggacatgggcagattgataacttttcattaggagttttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagaaagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattactggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctttggacttttcccctggaacgtcaggatctccaattgtcgacagaaaaggaaaagttgtgggtctttacggtaatggtgttgttacaaggagtggagcatacgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcatggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgctttgatggaattaagaacaaccaaatactggaagaaaacgtggaagtggaaatctggacaaaagaaggggaaaggaagaagttaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagtaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctggtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagccggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaactttagcaaaagaaggcatcaaaagaggggaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatacatgccctcagtcatagaaaaaatggaaacactacaaaggaaatatggaggagccttggtgaggaatccactctcacgaaactccacacatgagatgtactgggtatccaatgccaccgggaacatagtgtcatcagtgaacatgatttcaaggatgttgattaacagattcacaatgaaacacaagaaagccacttacgagccagacgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagccttgggggctatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgtttcttagagtttgaagccctaggattcttgaatgaagatcactggttctccagagggaactccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtatcaaaacaaggtggtgcgtgtacaaagaccaacaccaagaggcacagtaatggacatcatatcgagaaaagaccaaagaggcagcgggcaagtcggcacctatggccttaatacttttaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcatgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcgaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 940 - DNA, 10176 bp, Dengue virus
atgaataaccaacggaaaaaggcgagaagtacgcctttcaatatgctgaaacgcgagagaaaccgcgtgtcaactgtgcaacagctgactaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgtcttgagagggtttaggaaagagattggaaggatgctgaacatcttgaacaggagacgcaggacagccggcgtgattattatgttgattccaacagtaatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgccccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatattgagacatccaggctttaccataatggcagcaatcctggcatataccataggaacgacacatttccaaagggctctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacactatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagatctgccgttaccatggctacccggagcggacacacaaggatcaaattggatacagaaagagacgttggtcactttcaaaaatccccacgcgaagaaacaggacgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagtgaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtgacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttttccacaaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcgcacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgtgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctactatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacacacactgaccatactaatcagaacgggtttgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcttatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaactaataccggaaccataggcgccgtgtctctggacttttcccctggaacgtcaggatctccaattgtcgacagaaaaggaaaagttgtgggtctttacggtaatggtgttgttacaaggagtggagcatatgtgagtgccatagcccagaccgaaaaaagcattgaagacaatccagagatcgaagatgacattttccgaaagaaaagattgaccatcatggatctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagctcacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggttatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatcgggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacgtcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgctgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaagcacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagagatcgctgtgcagaactggttagcaagagtggggcgtgaaaggttatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccagatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 941 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgtggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgtaggacagcaggcgtgattattatgttgattccaacagtgatggcgttccatttaaccacacgcaatggagaaccacacatgatcgttggtaggcaggagaaagggaaaagtctcctgttcaaaacagaggatggtgttaacatgtgtaccctcatggccatagaccttggtgaattgtgtgaagacacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatagttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaacttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacaatggagtgctctccgagaacgggcctcgacttcaatgagatggtgctgctgcagatggaagacaaagcttggctggtgcacaggcaatggttcctagacctgccgttaccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacggggcatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgcaagatcccttttgagataacagatttggaaaaaagacacgtcttaggacgcctgattacagtcaacccaatcgtaacagaaaaagatgccccagtcaacatagaagcagaacctccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctgtggtgcaggcagatagtggttgcgttgtgagctggaaaaataaagaactgaaatgtggcagcgggatcttcatcacagataacgtacacacatggacagaacaatacaagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaagggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccgaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaggaaaacttggtcaactccttggtcacagccggacatgggcagattgacaacttttcactaggagtcttgggaatggcactgttcctggaagaaatgcttaggacccgagtaggaacgaaacatgcaacactgctagttgcactatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggtcctcaaaatagtgagaaatatggaaaaataccaattggcagtgactatcatggccatttcgtgtgtcccaaatgcagtgatattgcaaaacgcatggaaagtgagttgcacaatattggcagcggtgtccgtttctccactgctcctaacatcctcacagcagaaagcggattggataccactggcattgacgataaaaggtctcaatccaacagccatttttctaacaactctctcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagatcggagccggagtttacaaagaaggaacatttcatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatatgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgattatcatggacgaagcccacttcacagacccagcaagcatagcagctagaggatacatttcaactcgagtagagatgggtgaagcagcaggtattttcatgacagccactcctccgggaagcagagacccatttcctcagagcaatgcaccaatcatagatgaggagagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccgttgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaagggcgcacaatcatgctctcagtgaactgccggagaccctggagacactgcttctactgacactcctggcaacagtcacaggaggaattttcttattcttaatgagcggaaaaggtatagggaagatgactctgggaatgtgttgcataatcacagctagcatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttactggtagcacattatgctattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgtgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaatacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaatatggtcacaccggaagggaaggtggtggatcttggttgcggcagagggggctggtcatactattgtgggggactaaagaatgtaagagaagtcaaaggcctaacaaaaggaggaccaggacacgaggaacccatccccatgtcaacatatgggtggaatctagtgcgtctgcaaagtggtgttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagagaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggcacctatggccttaatactttcaccaatatggaagcccaattaattagacagatggaaggagaaggaatcttcaaaagcattcagcacctgaccgccacagaagaaatcgctgtacagaactggctagcaagagtggggcgtgaaaggctatcaagaatggccatcagtggagatgactgtgttgtaaaacccatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcctgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 942 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgttttctaacaatcccaccaacagcagggatactaaaaagatggggaacgatcaaaaaatcaaaagctatcaatgttctgagagggttcaggaaagagattggaaggatgctgaacatcttgaacaggagacgtaggacagcaggcgtgattgttatgttgattccaacagtgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatagttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaacttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacaatggagtgctctccgagaacgggcctcgacttcaatgagatggtgctgctgcagatggaagacaaagcttggctggtgcacaggcaatggttcctagacctgccgttaccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagtcaacccaatcgtaacagaaaaagatgccccagtcaacatagaagcagaacctccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatacaagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaagggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaggaaaacttggtcaactccttggtcacagccggacatgggcagattgacaacttttcactaggagtcttgggaatggcactgttcctggaagaaatgcttaggacccgagtaggaacgaaacatgcaacactgctagttgcactatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggtcctcaaaatagtgagaaatatggaaaaataccaattggcagtgactatcatggccatttcgtgtgtcccaaatgcagtgatattgcaaaacgcatggaaagtgagttgcacaatattggcagcggtgtccgtttctccactgctcctaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacatttcatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatatgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgattatcatggacgaagcccacttcacagacccagcaagcatagcagctagaggatacatttcaactcgagtagagatgggtgaagcagcaggtattttcatgacagccactcctccgggaagcagagacccatttcctcagagcaatgcaccaatcatagatgaggagagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaagggcgcacaatcatgctctcagtgaactgccggagaccctggagacactgcttctactgacactcctggcaacagtcacaggaggaattttcttattcttaatgagcggaaaaggtatagggaagatgactctgggaatgtgttgcataatcacagctagcatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgctattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaatatggtcacaccggaagggaaggtggtggatcttggttgcggcagagggggctggtcatactattgtgggggactaaagaatgtaagagaagtcaaaggcctaacaaaaggaggaccaggacacgaagaacccatccctatgtcaacatatgggtggaatctagtgcgtctgcaaagtggtgttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggcacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacccatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcctgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 943 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagaaccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacttttcttattgatggccctgaaacagcagaatgccccaacacaaacagagcttggaactcgctggaagttgaagactatggttttggagttttcaccaccaatatatggctgaaattgagagaaaagcaggatgtattttgtgactcaaaactcatgtcagcggccatcaaagacaacagagccgttcatgccgatatgggttattggatggaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcatctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaagcagaaatatcaggaagcagtccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggcgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagatatcttccagccatagttagagaagccataaaacgtggcttgagaacattgatcctggctcccactagagtagtggcagctgaaatggaagaagctcttagaggacttccaataagataccaaaccccagccatcaaaaccgagcacaccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaagggaaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggagccccttgaaaatgatgaagactgtgcacattggaaagaagctaaaatgctcctagataacatcaatacacccgaaggaatcattcctagtatgttcgaaccggagcgtgagaaagtggatgccattgatggtgaataccgtttgagaggggaagcaaggaaaacctttgtggacctaatgagaagaggggacttaccagtctggttggcctacaaagtggcagctgaaggcatcaattacacagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccagttgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttctatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagacacccaggatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgctatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagagacaggtgtcctgtggtag

SEQ ID NO: 944 - DNA, 10176 bp, Dengue virus; identical to SEQ ID NO: 805

SEQ ID NO: 945 - DNA, 10176 bp, Dengue virus; identical to SEQ ID NO: 806

SEQ ID NO: 946 - DNA, 10176 bp, Dengue virus
atgaataaccaacgaaaaaaggcgagaagtacgcctttcaatatgctgaaacgcgagagaaaccgcgtgtcaactgtgcaacagttgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaagagacgcaggacagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtactctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggttttaccataatggcagcaatcctggcatataccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaggagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttgctgttcacaggacatctcaagtgcaggctgagaatggacaaactacagctcaaaggaatgtcatactccatgtgtacaggaaagtttaaaattgtgaaggaaatagcagaaacacaacatggaacaatagttatcagagtacaatatgaaggggacggttctccatgcaagatcccttttgagataacagatttggaaaaaagacacgtcttaggtcgcttgattacagttaacccaatcgtaacagaaaaagatagcccagtcaacatagaagcagaacctccattcggagacagctacatcattataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgttgtgacactgtacctgggagctatggtgcaagctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattagaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaggttagaccaacttttgcagctggactactcttaagaaaactgacctccaaggaattgatgatggctaccataggaatcgcactcctttcccaaagcaccataccagagaccattctagaactgactgatgcattagccctgggcatgatggtcctcaaaatagtgagaaatatggaaaaataccaattggcagtgactatcatggctatttcatgtgtcccaaatgcagtgatactgcaaaacgcatggaaggtgagttgcacaatattggcagcggtgtccgtttcaccactgctcttaacatcctcacagcagaaagcggattggataccactggcattgacgataaaaggtctcaatccaacagccatttttttaacaactctctcgaggaccagcaagaaaaggagctggccgctaaatgaagctatcatggcagttgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtaaagaaacaacgggctggagtactgtgggacgtcccttcacccccaccagtggaaaaagccgaactggaggatggagcctacagaatcaagcaaagagggatccttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaatattcaaaaccaacaccggaaccataggcgccgtatctctggacttttcccctggaacgtcaggatctccaatcgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccaccagagtagtggcagctgaaatggaggaagctcttagaggacttccaataagataccaaactacagctatcaaaaccgaacataccgggcgggagatcgtggacctaatgtgtcatgccacatttactatgaggctgttatcaccagtcagagtgccaaattacaacctgatcatcatggacgaagcccactttacagacccagcaagtatagcagctagaggatacatttcaactcgagtagagatgggtgaagcagccgggattttcatgacagccactcctccgggaagtagagacccatttcctcagagcaatgcaccaattatggatgaggaaagagaaatccctgagcgttcatggaattcaggacacgaatgggtcacggattttaaagggaagactgtttggtttgttccaagcataaaagcaggaaatgatatagcagcttgtcttaggaaaaatggaaagaaagtgatacaactcagtaggaagacttttgactctgagtatgttaagactagagccaatgattgggactttgtggtcacgactgacatttcagaaatgggtgccaacttcaaggctgagagggttatagaccccagacgttgcatgaaaccagttatactaacagatggcgaagagcgggtgatcttggctggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataatatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatggaagtggaaatctggacaaaagaaggggaaaggaaaaaattaaaacccagatggttggatgctaggatttattctgacccactggcactaaaagaattcaaggaatttgcagctggaagaaaatctttgaccctgaacctaattacagaaatgggtaggcttccaactttcatgactcagaaagcaagaaacgcactggacaacctggctgtgctgcatacggctgaggcaggtggaagggcgtacaatcatgctctcagtgaactgccggagaccctggagacactgctcctactgacacttctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacacttgtcacaccaatgttgagacacagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagaggaggctggtcatactattgcgggggactaaagaatgtaagagaagtcaaaggcctaacaaaaggaggaccaggacatgaagaacccatccccatgtcaacatatgggtggaatttagtgcgtctgcaaagtggagttgacgttttcttcaccccgccagaaaagtgtgaaacattgttgtgtgacataggggagtcgtcaccaaatcccacgatagaagcaggacgaacactcagagtcctcaacttagtggaaaattggttgaacaataacacccaattctgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacataggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttctgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaactaacgtaccaaaacaaggtggtgcgtgtgcaaagaccaacaccaagaggcacagtaatggatatcatatcgagaagagaccaaagaggcagtgggcaagtcggcacctatggccttaataccttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaaattagaaaagatatacaacaatgggaaccttcaagaggatggaacgattggacacaagtgcctttctgttcacaccactttcatgagttagtcatgaaagatggtcgcgtgctcgtagtcccatgcagaaaccaagatgaactgattggtagagcccgaatttcccagggagctgggtggtctttgaaagagacggcctgtttgggaaagtcttacgcccaaatgtggactctgatgtacttccacagacgtgacctcagactggcggcaaatgccatctgctcggcagtcccgtcacattgggttccaacaagtcgaacaacttggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagatttagaagggaagaggaagaggcaggtgtcctgtggtag

SEQ ID NO: 947 - DNA, 10176 bp, Dengue virus
atgaataaccaacggaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctattaatgttttgagagggtttaggaaagagattggaaggatgctgaacatcttgaacaggagacgcaggacagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtccccttctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccatagggacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaagggaatcatgcaggcaggaaaacgatctttgcggccccagcccactgagctgaagtactcatggaaaacatggggaaaggcgaaaatgctctccacagagtctcacaatcagaccttccttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtactggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcggaatggtgagcattttagccagttctctcctaaagaatgacattcccatgacaggtccattagtggctggagggcttcttactgtgtgttacgtgctcactggacggtcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgttgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctctgaccctgaatctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtgacaggaggaatcttcttatttttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacatcggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgttgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaacactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 948 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactaaaaagatggggaacaatcaaaaaatcaaaagctatcaatgttttgagagggttcaggaaagaaattggaaggatgctgaacatcttgaacaggagacgcaggacagcaggcgtgattgttatgttgattccaacagcgatggcgtttcatttaaccacacgcaatggagaaccacacatgatcgttggtaggcaggagaaaggaaaaagtcttctgttcaaaacagaggatggtgtcaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccactacaggggaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatctcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtgcagccagaaaatttggaatacaccatcatgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtacacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcatacggcactcacaggggccacagaaatccagatgtcatcaggaaacttactgttcacaggacatctcaagtgcaggctgagaatggacaaactacagctcaaaggaatgtcatactctatgtgcacaggaaagtttaaaattgtgaaggaaatagcagaaacacaacatggaacaatagttatcagagtacaatatgaaggggacggttctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggattttggatccctgggaggagtgtttacatctgtaggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactatacctgggagctatggtgcaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctctgcggccccagcccactgagctgaagtactcatggaaaacatggggaaaggcgaaaatgctctctacagagtctcacaatcagacctttcttattgatggccctgaaacagcagaatgccccaacacaaacagagcttggaactcgctggaagtcgaagactatggttttggagtttttaccaccaatatatggctaaaattgagagaaaaacaggatgtattttgtgactcaaaactcatgtcagcggccattaaagacaacagagccgtccatgctgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggcaagcttgagatggactttgatttctgcgaaggaactacagtggtggtgactgaggactgtggaaatagaggaccttctttaagaacgaccactgcctctggaaaactcataacagaatggtgctgccgatcctgtacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggtgctaccatgacggatgacataggtatgggagtgacttatcttgccctactagcagctttcaaagttagaccaacttttgcagctggactactcttgagaaaactgacctccaaggaattaatgatggccaccataggaatcgctctcctttcccaaagcaccataccagagaccattcttgaactgactgatgcgttagccttgggcatgatggctctcaaaatagtgaaaaatatggaaaagtaccaattggcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacgactctttcgagaaccagcaagaaaaggagctggccgctaaatgaagctatcatggcagttgggatggtgagcattttagccagttctctcctgaagaatgatattcccatgacaggtccattagtggctggagggctccttacagtatgttacgtgctcactggacgatcggccgatttggaactagagagagctgccgatgtaaaatgggaagatcaggcagaaatatcaggaagcagcccaatcctgtcaataacaatatcagaagatggcagcatgtcgataagaaatgaagaggaagaacaaacactgaccatactcatcagaacgggattgttggtgatctcaggagtctttccagtatcgataccagttacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctagtatcatatggaggaggctggaagctagaaggagaatggaaggaaggagaggaagtccaagtcctggcattagaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagaaatcgaagatgacattttccgaaagaaaagattgaccatcatggaccttcatccaggagcaggaaagacaaaaagataccttccagccatagttagagaagccataaaacgtggcttgagaacattaatcctggctcccaccagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggattttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgacgaagactgtgcacattggaaagaagccaaaatgctcctagataacatcaacacacccgaaggaatcattcctagtatgttcgaaccagagcgtgaaaaagtggatgccattgatggtgaataccgtttgagaggagaagcaaggaaaaccttcgtggacctaatgagaagaggggacttaccagtctggttagcctacaaagtggcagctgaaggcatcaactacgcagacagaaggtggtgttttgatggaattaagaataaccaaatactggaagaaaatgtggaagtggaaatctggacaaaagaaggggaaaggaaaaaattaaaacccagatggttggatgctaggatctattctgacccactggcactaaaagaattcaaggaatttgcagccgggagaaaatctttgaccctgaatctaatcacagaaatgggtaggcttccaactttcatgactcagaaggcaagaaacgcactggacaacttggctgtgctgcatacggctgaggcaggtggaaaggcgtataatcatgctctcagtgaactgccggagaccctggagacactgcttctactaacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtggccacaacatttgtcacaccaatgttgaggcatagcattgaaaattcctcagtgaatgtctccctaacagccattgctaaccaagctacagtgctaatgggtcttgggaaaggatggccattgtcaaagatggacatcggagttcccctcctcgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccctggcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatcaccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaatccatatatgccctcagtcatagaaaaaatggaaacactacaaaggaaatatggaggagccttagtgaggaatccactctcacgaaactccacgcatgagatgtactgggtatctaatgccactgggaacatagtgtcatcagtgaacatgatttcaaggatgttgattaacagattcacaatgaaacacaagaaagccacctacgagccggatgttgacctgggaagtggaactcgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaacccaagaaccgaaggaaggcacaaagaaactgatgaaaattacggcagagtggctttggaaagaactaggaaagaaaaagacacccaggatgtgtaccagagaagaattcacaagaaaggtgagaagcaatgcagccttgggggccatattcactgatgagaacaaatggaaatcggcacgtgaggctgttgaagatggtaggttttgggagctggttgacagggaaagaaatctccatcttgaaggaaagtgtgagacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaagctagccgaggccatattcaaattaacgtaccaaaacaaagtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagtcacagaagaaatcgctgtacagaactggctagcaagagtggggcgtgaaaggctatcaagaatggccatcagtggagatgattgtgttgtaaaacccatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccaaggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacgagtcgaacaacctggtccatacacgctaagcatgaatggatgacgacggaggacatgctggcagtctggaacagggtgtggatccaagaaaacccgtggatggaagacaaaactccagtggaatcatgggaagaagtcccatacttggggaaaagagaagaccaatggtgtggctcattgattgggctaacaagcagggctacctgggcaaagaacatccaaacagcaataaaccaagtcagatcccttataggcaatgaggaatacacagactacatgccatccatgaagagattcagaagggaagaggaagaggcaggtgtcctgtggtag

SEQ ID NO: 949 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactaaaaagatggggaacaatcaaaaaatcaaaagctatcaatgttttgagagggttcaggaaagaaattggaaggatgctgaacatcttgaacaggagacgcaggacagcaggcgtgattgttatgttgattccaacagcgatggcgtttcatttaaccacacgcaatggagaaccacacatgatcgttggtaggcaggagaaaggaaaaagtcttctgttcaaaacagaggatggtgtcaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccactacaggggaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatctcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtgcagccagaaaatttggaatacaccatcatgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtacacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcatacggcactcacaggggccacagaaatccagatgtcatcaggaaacttactgttcacaggacatctcaagtgcaggctgagaatggacaaactacagctcaaaggaatgtcatactctatgtgcacaggaaagtttaaaattgtgaaggaaatagcagaaacacaacatggaacaatagttatcagagtacaatatgaaggggacggttctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggattttggatccctgggaggagtgtttacatctgtaggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactatacctgggagctatggtgcaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctctgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagtcgaagactatggttttggagtttttaccaccaatatatggctaaaattgagagaaaaacaggatgtattttgtgactcaaaactcatgtcagcggccattaaagacaacagagccgtccatgctgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggcaagcttgagatggactttgatttctgcgaaggaactacagtggtggtgactgaggactgtggaaatagaggaccttctttaagaacgaccactgcctctggaaaactcataacagaatggtgctgccgatcctgtacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggtgctaccatgacggatgacataggtatgggagtgacttatcttgccctactagcagctttcaaagttagaccaacttttgcagctggactactcttgagaaaactgacctccaaggaattaatgatggccaccataggaatcgctctcctttcccaaagcaccataccagagaccattcttgaactgactgatgcgttagccttgggcatgatggctctcaaaatagtgaaaaatatggaaaagtaccaattggcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacgactctttcgagaaccagcaagaaaaggagctggccgctaaatgaagctatcatggcagttgggatggtgagcattttagccagttctctcctgaagaatgatattcccatgacaggtccattagtggctggagggctccttacagtatgttacgtgctcactggacgatcggccgatttggaactagagagagctgccgatgtaaaatgggaagatcaggcagaaatatcaggaagcagcccaatcctgtcaataacaatatcagaagatggcagcatgtcgataagaaatgaagaggaagaacaaacactgaccatactcatcagaacgggattgttggtgatctcaggagtctttccagtatcgataccagttacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctagtatcatatggaggaggctggaagctagaaggagaatggaaggaaggagaggaagtccaagtcctggcattagaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagaaatcgaagatgacattttccgaaagaaaagattgaccatcatggaccttcatccaggagcaggaaagacaaaaagataccttccagccatagttagagaagccataaaacgtggcttgagaacattaatcctggctcccaccagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggattttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgacgaagactgtgcacattggaaagaagccaaaatgctcctagataacatcaacacacccgaaggaatcattcctagtatgttcgaaccagagcgtgaaaaagtggatgccattgatggtgaataccgtttgagaggagaagcaaggaaaaccttcgtggacctaatgagaagaggggacttaccagtctggttagcctacaaagtggcagctgaaggcatcaactacgcagacagaaggtggtgttttgatggaattaagaataaccaaatactggaagaaaatgtggaagtggaaatctggacaaaagaaggggaaaggaaaaaattaaaacccagatggttggatgctaggatctattctgacccactggcactaaaagaattcaaggaatttgcagccgggagaaaatctttgaccctgaatctaatcacagaaatgggtaggcttccaactttcatgactcagaaggcaagaaacgcactggacaacttggctgtgctgcatacggctgaggcaggtggaaaggcgtataatcatgctctcagtgaactgccggagaccctggagacactgcttctactaacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtggccacaacatttgtcacaccaatgttgaggcatagcattgaaaattcctcagtgaatgtctccctaacagccattgctaaccaagctacagtgctaatgggtcttgggaaaggatggccattgtcaaagatggacatcggagttcccctcctcgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaacgatgaggactacatgggctttgtgcgaggctctaaccttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccctggcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaatccatatatgccctcagtcatagaaaaaatggaaacactacaaaggaaatatggaggagccttagtgaggaatccactctcacgaaactccacgcatgagatgtactgggtatctaatgccactgggaacatagtgtcatcagtgaacatgatttcaaggatgttgattaacagattcacaatgaaacacaagaaagccacctacgagccggatgttgacttgggaagtggaactcgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaacccaagaaccgaaggaaggcacaaagaaactgatgaaaattacggcagagtggctttggaaagaactaggaaagaaaaagacacccaggatgtgtaccagagaagaattcacaagaaaggtgagaagcaatgcagccttgggggccatattcactgatgagaacaaatggaaatcggcacgtgaggctgttgaagatggtaggttttgggagctggttgacagggaaagaaatctccatcttgaaggaaagtgtgagacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaagctagccgaggccatattcaaattaacgtaccaaaacaaagtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagtcacagaagaaatcgctgtacagaactggctagcaagagtggggcgtgaaaggctatcaagaatggccatcagtggagatgattgtgttgtaaaacccatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccaaggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacgagtcgaacaacctggtccatacacgctaagcatgaatggatgacgacggaggacatgctggcagtctggaacagggtgtggatccaagaaaacccgtggatggaagacaaaactccagtggaatcatgggaagaagtcccatacttggggaaaagagaagaccaatggtgtggctcattgattgggctaacaagcagggctacctgggcaaagaacatccaaacagcaataaaccaagtcagatcccttataggcaatgaggaatacacagactacatgccatccatgaagagattcagaagggaagaggaagaggcaggtgtcctgtggtag

SEQ ID NO: 950 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcctctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattagaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatatagaggtgaggatggatgctggtacgggatggaaatcagaccattgaaagagaaagaggagaatttggtcaactccttggtcacagccggacatgggcagattgacaacttttcactaggaatcttaggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtcttaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacttgtgggaagtgaagaaacaacgggctggagtattgtgggacgtcccttcacccccaccagtggaaaaagccgaactggaagatggagcctatagaatcaagcaaagagggattcttggatattctcagattggagccggagtttacaaagaaggaacatttcatacaatgtggcacgtcacacgtggtgctgttctgatgcatagagggaagagggttgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagactgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggccacaacatttgtcacaccaatgttgagacatagcattgaaaattcctcagtgaatgtctccctaacagctattgctaaccaagccacagtgctaatgggtcttgggaaaggatggccattgtcaaagatggacattggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacaaatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatctcccagggagccgggtggtctttgaaggagacggcctgtttggggaagtcttacgcccaaatgtgggccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 951 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttactataatggcagcaatcctggcatataccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtaacgacgatggcaaaaaataaaccaacattggattttgaactaataaaaacagaagccaaacaacctgccactctaaggaagtactgtatagaagcaaagctgaccaatacaacaacagaatctcgttgcccaacacaaggggaacccagtctaaatgaagagcaggacaaaaggttcctctgcaaacactccatggtagacagaggatggggaaatggatgtggattatttggaaagggaggcattgtgacctgtgctatgtttacatgcaaaaagaacatggaaggaaaagtcgtgcagccagaaaatctggaatacaccatcgtgataacaccccactcaggagaagagcacgctgtaggcaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccatcttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtacaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaagtaacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgtattttgtgactcaaaactcatgtcagctgccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattagaaagtgagatgataattccaaaaaattttgctgggccagtgtcacaacacaactacagaccaggctaccatacacaaacagcaggaccttggcatctaggtaagcttgagatggactttgatttctgcgaaggaactacagtggtggtgactggggactgtggaaatagaggaccctctttaagaacgaccaccgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacctatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagtggtgtccgtttctccactgcttttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcggaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctttgggaagtgaaaaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggatcgaaccatcatgggcagacgtcaagaaagacttaatatcatatggaggaggctggaagctagaaggagaatggaaggaaggagaggaagtccaagtcctggcattggaacctggaaaaaatccaagagccgtccaaacaaaacctggacttttcaaaactaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcctactagagtcgtggcagctgaaatggaggaagctcttagaggacttccaataagataccaaaccccagccatcagagccgagcacactgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaaaggcgtacaatcatgctctcagtgaactgccggaaaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctactcacaagtcaaccctataacactcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtaatgatgatgaggactacatgggctctgtgtgaggctctaaccttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaagagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatacatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctagggagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaagcaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaattcacaagaaaggtgagaagcaatgcagccttgggggccatattcactgatgagaacaaatggaaatcggcacgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggggcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggtcatcagtggagatgattgtgttgtaaagcctttagatgacagatttgcaagtgctttaacagctctaaatgacatgggaaaagtcaggaaagatatacaacaatgggaaccttcaagaggatggaacgattggacacaagtgcctttctgttcacaccattttcatgagttagtcatgaaagatggtcgcgtgctcgtagtcccgtgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacattcaaacagcaataaatcaagtcagatcccttataggcaatgaggaatacacagactacatgccatccatgaagagatttagaagggaagaggaagaggcaggtgtcctgtggtag

SEQ ID NO: 952 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcctctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggggctatggtgcaggctgatagtggttgcgttgtgagctggaaaaataaagaactgaaatgtggcagcgggatcttcattacagacaacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgagctggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaaaacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaggggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctggtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatacatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaagtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 953 - DNA, 10176 bp, Dengue virus; identical to SEQ ID NO: 781

SEQ ID NO: 954 - DNA, 10176 bp, Dengue virus
atgaacaaccaacgaaaaaaggcgagaagtacgcctttcaatatgctgaaacgcgagagaaaccgcgtgtcaactgtgcaacagctgacaaagagattctcacttggaatgctgcaaggacgaggaccattaaaactgttcatggcccttgtggcgttccttcgtttcctaacaatcccaccaacagcagggatactgaaaagatggggaacgatcaaaaaatcaaaagctatcaatgttttgagagggttcaggaaagagattggaaggatgctgaacatcttgaacaggagacgcaggacagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgatttttatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacaggaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactacttttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctactatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactatgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 955 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaaatactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 956 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggtttaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgcggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgtcctgtggtag

SEQ ID NO: 957 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggtttaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacaggaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacttagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag

SEQ ID NO: 958 - DNA, 10176 bp, Dengue virus
atgaataaccaacgaaaaaaggcgagaagtacgcctttcaatatgctgaaacgcgagagaaaccgcgtgtcaactgtgcaacagctgacaaagagattctcacttggaatgctgcaaggacgcggaccattaaaactgttcatggcccttgtggcgttccttcgtttcctaacaatcccaccaacagcagggatactaaaaagatggggaacgatcaaaaaatcaaaagctatcaatgttttgagagggttcaggaaagagattggaaggatgctgaacatcttgaacaggagacgcaggacagcaggcgtgattgtgatgttgattccaacagcgatggcgttccatttaaccacacgcaatggagaaccacacatgatcgttggtaggcaggaaaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgagacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcacgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaacttggagtacactatcgtgataacacctcactcaggagaagagcacgctgtaggtaatgacacaggaaagcatggcaaagaaatcaaaataacaccacagagttccatcacagaagcagaactgacaggctatggcaccgtcacgatggagtgctctccgagaacgggcctcgacttcaatgagatggtgctgctgcagatggaagacaaagcttggctggtgcacaggcaatggtttctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcagggaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctgtggtgcaagctgatagtggttgcgttgtgagctggaaaaataaagaactgaaatgtggcagtgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccatcaaagacaacagagccgttcatgccgatatgggttattggatagaaagtgcactcaatgacacatggaagatggagaaagcctccttcattgaagttaaaagctgccactggccaaagtcacacaccctttggagcaatggagtattagaaagtgagatgataatcccaaaaaattttgccgggccagtgtcacaacacaactacagaccaggctaccacacacaaacagcaggaccttggcacctaggtaagcttgagatggactttgatttctgcgaaggaactacagtggtggtaactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgtttctggaagaaatgctcaggacccgaataggaacgaaacatgcaatactgctagttgcagtatcttttgtgacactgataactgggaacatgtcgtttagagacctgggaagagtgatggttatggtgggcgctaccatgacggatgacataggtatgggagtgacttatcttgccctactagcagcttttaaagttagaccaacttttgcagctggactactcttgagaaaactgacttccaaggaattgatgatggccaccataggaatagcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttcaccactgctcttaacatcctcacagcagaaagcggattggataccactggcattgacaataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccactagtggctggagggctccttaccgtatgttacgtgctcactggacgatcggccgatttggaactggagagagctgctgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgttggtgatctcaggagtctttccagtatcgataccaattacggcagcagcatggtacctgtgggaagtgaagaaacaacgggctggagtattgtgggacgtcccttcacccccaccagtggaaaaagccgaactggaggatggagcctacagaatcaagcaaagagggattcttggatattctcagataggagctggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgttcaaacgaaacctggaattttcaaaaccaacaccggaaccataggcgccgtatctctggacttttcccctggaacgtcaggatctccaattgtcgacagaaaaggaaaagttgtgggtctttacggcaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaagaagctcttagaggacttccaataagataccaaaccccagccatcaaaaccgagcataccgggcgggagatcgtggacctaatgtgtcatgccacatttactatgaggttgctatcaccagtcagagtgccaaattacaacctgatcatcatggacgaagcccacttcacagacccagcaagtatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggcgccaacttcaaggctgaaagggttatagaccccagacgttgcatgaaaccagttatactaacagatggcgaagagcgggtgatcttggcaggacctatgccagtgacccactctagcgcagcgcaaagaagagggagaataggaagaaatccaaaaaatgaaaatgaccagtacatatacatgggggaaccccttgaaaatgatgaagactgtgcacattggaaagaagctaaaatgctcctggataacatcaatacacccgaaggaatcattcctagtatgttcgaaccggagcgtgaaaaagtggatgccattgatggtgaataccgtttgagaggggaagcaaggaaaacctttgtggacctaatgagaagaggggacttaccagtctggttggcctacaaagtggcagctgaaggcatcaattacgcagacagaaagtggtgttttgatggaattaagaacaaccaaatactggaagaaaatatggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggagaaaaccaagaaagacctcggactgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccatcgctaaccaagctacagtgctaatgggtcttgggaaaggatggccattgtcaaagatggacattggagttcccctccttgccattggatgctattcacaagtcaaccctataactctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaatactaccattgcagtgtcaatggccaacatctttagggggagctacttggccggagctggacttctcttttccatcatgaaaaacacaacaagcacaagaagaggaactggcaacataggagagacacttggagaaaaatggaaaagtcgattaaacgcactggggaaaagtgaatttcaaatctacaagaaaagtggaatccaggaagtggatagaaccctagcaaaagaaggtataaaaagaggagaaacggaccaccatgctgtgtcgcgaggttcagcaaaattgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtctgcaaagtggagttgacgttttcttcaccccgccggaaaagtgtgacacattgctgtgtgacataggggagtcgtcaccaaatcccacgatagaagcaggacgaacactcagagtcctcaacttagtggaaaattggttgaacaataacacccaattttgcataaaggtcctcaatccatatatgccttcagtcatagaaaaaatggaagcattacaaaggcaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaatatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactaatgaaaattacggcagagtggctttggaaagaactaggaaagaaaaagacacccaggatgtgtaccagagaagaattcacaaaaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagttggcacctatggccttaacactttcaccaatatggaagcccaattaattagacagatggagggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttagaaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaatcaagtcagatccctcataggcaatgaggaatacacagactacatgccatccatgaagagattcagaagggaagaggaagaggcaggtgttctgtggtag
